United States Patent
Begemann et al.

(10) Patent No.: US 9,896,696 B2
(45) Date of Patent: Feb. 20, 2018

(54) COMPOSITIONS AND METHODS FOR MODIFYING GENOMES

(71) Applicant: BENSON HILL BIOSYSTEMS, INC., Research Triangle Park, NC (US)

(72) Inventors: Matthew Begemann, St. Louis, MO (US); Benjamin Neil Gray, Chapel Hill, NC (US)

(73) Assignee: Benson Hill Biosystems, Inc., Research Triangle Park, NC (US)

(*) Notice: Subject to any disclaimer, the term of this patent is extended or adjusted under 35 U.S.C. 154(b) by 0 days.

(21) Appl. No.: 15/432,109

(22) Filed: Feb. 14, 2017

(65) Prior Publication Data

US 2017/0233756 A1    Aug. 17, 2017

Related U.S. Application Data

(60) Provisional application No. 62/295,325, filed on Feb. 15, 2016, provisional application No. 62/372,108, filed on Aug. 8, 2016, provisional application No. 62/403,854, filed on Oct. 4, 2016, provisional application No. 62/429,112, filed on Dec. 2, 2016, provisional application No. 62/450,743, filed on Jan. 26, 2017.

(51) Int. Cl.
| | |
|---|---|
| *C12N 15/82* | (2006.01) |
| *C12N 9/22* | (2006.01) |
| *C12N 15/62* | (2006.01) |
| *C12N 15/10* | (2006.01) |

(52) U.S. Cl.
CPC .......... *C12N 15/8274* (2013.01); *C12N 9/22* (2013.01); *C12N 15/102* (2013.01); *C12N 15/62* (2013.01); *C12N 15/8202* (2013.01); *C12N 15/8213* (2013.01)

(58) Field of Classification Search
None
See application file for complete search history.

(56) References Cited

U.S. PATENT DOCUMENTS

| | | | | |
|---|---|---|---|---|
| 7,462,481 B2 * | 12/2008 | Castle | ............... | C12N 9/1029 |
| | | | | 435/193 |
| 2014/0356956 A1 | 12/2014 | Church et al. | | |
| 2016/0208243 A1 * | 7/2016 | Zhang | ............... | C12N 15/8201 |
| 2016/0362668 A1 * | 12/2016 | May | ............... | C12N 15/902 |

FOREIGN PATENT DOCUMENTS

| | | |
|---|---|---|
| EP | 3 009 511 A2 | 4/2016 |
| WO | WO 2015/071474 A2 | 5/2015 |
| WO | WO 2017/015015 A1 | 1/2017 |

OTHER PUBLICATIONS

Zetsche, B., et al., "Cpf1 is a Single RNA-Guided Endonuclease of a Class 2 CRISPR-Cas System," *Cell*, 2015, vol. 163, pp. 1-13.
U.S. Appl. No. 62/193,921, for "CRISPR-Associated Protein From *Francisella* and Uses Related Thereto," filed Jul. 17, 2015, pp. 1-68.
NCBI Reference Sequence: WP_003034647.1 for "conserved hypothetical protein [*Francisella novicida*]," May 6, 2013, 1 page.
NCBI Reference GenBank AJI56734.1 for "CRISPR-associated protein Cpf1, subtype PREFRAN [*Francisella philomiragia*]," Sep. 15, 2014, 1 page.
Database UniProt:D8E0G1, "Uncharacterized Protein," 2010, 1 page.
Database Uniprot:A0A091FC75, "Uncharacterized Protein," 2014, 1 page.
Jung, T., et al., "Crystal Structure of the Csm1 Subunit of the Csm Complex and Its Single-Stranded DNA-Specific Nuclease Activity," *Structure*, 2015, vol. 23(4), pp. 782-790.
Purushe, J., et al., "Comparative Genome Analysis of *Prevotella ruminicola* and *Prevotella bryantii*: Insights into Their Environmental Niche," *Microb Ecol*, 2010, vol. 60(4), pp. 721-729.

* cited by examiner

*Primary Examiner* — Brent T Page
(74) *Attorney, Agent, or Firm* — Womble Bond Dickinson (US) LLP

(57) ABSTRACT

Compositions and methods for modifying genomic DNA sequences are provided. The methods produce double-stranded breaks (DSBs) at pre-determined target sites in a genomic DNA sequence, resulting in mutation, insertion, and/or deletion of DNA sequences at the target site(s) in a genome. Compositions comprise DNA constructs comprising nucleotide sequences that encode a Cpf1 or Csm1 protein operably linked to a promoter that is operable in the cells of interest. The DNA constructs can be used to direct the modification of genomic DNA at pre-determined genomic loci. Methods to use these DNA constructs to modify genomic DNA sequences are described herein. Additionally, compositions and methods for modulating the expression of genes are provided. Compositions comprise DNA constructs comprising a promoter that is operable in the cells of interest operably linked to nucleotide sequences that encode a mutated Cpf1 or Csm1 protein with an abolished ability to produce DSBs, optionally linked to a domain that regulates transcriptional activity. The methods can be used to up- or down-regulate the expression of genes at predetermined genomic loci.

24 Claims, 6 Drawing Sheets

FIGURE 2 (GE0001; FnCpf1)

A

```
WT    : TTCGATCGTAGCATCCATGACCACTGTGGCATCGCTGTCTTTGCTGCCGACACTTGCTCTCATCAAGCCTTCCTTCAGGTGTTGCTCCAGAAAGGTGAGTT
31-21 : TTCGATCGTAGCATCCAT-----------------------------------------------------TTTTGTTTCA----------GGTGTTGCTCCAGAAAGGTGAGTT
80-33 : TTCGATCGTAGCATCCATGACCACTGTGGCATCGCTGTCTTTGCTGCCGACACTTGCTCATC----------CTTCAGGTGTTGCTCCAGAAAGGTGAGTT
91-04 : TTCGATCGTAGCATCCATGACCACTGTGGCATCGCTGTCGTTGCTGCCGACACTTGCTCATCA---------CAGGTGTTGCTCCAGAAAGGTGAGTT
119-04: TTCGATCGTAGCATCCATGACCACTGTGGCATCGCTGTCGTTGCTGCCGACACTTGCTCA------------TCCTTCAGGTGTTGCTCCAGAAAGGTGAGTT
119-11: TTCGATCGTAGCATCCATGACCACTGTGGCATCGCTGTCTTTGCTGCCGACACTTGCTCA------------TCCTTCAGGTGTTGCTCCAGAAAGGTGAGTT
81-09 : TTCGATCGTAGCATCCATGACCACTGTGGCATCGCTGTCGTTGCTGCCGACACTTGCT--------------CTTCAGGTGTTGCTCCAGAAAGGTGAGTT
81-30 : TTCGATCGTAGCATCCATGACCACTGTGGCATCGCTGTCGTTGCTGCCGACACTTGCTCA------------TCCTTCAGGTGTTGCTCCAGAAAGGTGAGTT
81-46 : TTCGATCGTAGCATCCATGACCACTGTGGCATCGCTGTCTTTGCTGCCGACACTTGCTCA------------TCCTTCAGGTGTTGCTCCAGAAAGGTGAGTT
93-47 : TTCGATCGTAGCATCCATGACCACTGTGGCATCGCTGTCGTGTCTTTGCTGCCGC----------------------------CGAGTT
97-112: TTCGATCGTAGCATCCATGACCACTGTGGCATCGCTGTCTTTGCTGCCGACACTTGCTCA------------TCCTTCAGGTGTTGCTCCAGAAAGGTGAGTT
97-141: TTCGATCGTAGCATCCATGACCACTGTGGCATCGCTGTCTTTGCTGCCGACACTTGCTCA------------TCCTTCAGGTGTTGCTCCAGAAAGGTGAGTT
```

B

```
WT    : TTGCTTTCTCCAGTGACCCTAAAAGACGATACAAATGGTA
46-38 : TTGCTTTCTCCAGTGACCCTAAAA-----------ATGGTA
46-38 : TTGCTTTCTCCAGTGACCCTAAAA-----------CAATGGTA
46-77 : TTGCTTTCTCCAGTGACCCTAAAA----GATACAAATGGTA
46-77 : TTGCTTTCTCCAGTGACCCTAAAA-----------CAATGGTA
46-86 : TTGCTTTCTCCAGTGACC------------------TGGTA
46-88 : TTGCTTTCTCCAGTGACCCTAA-------------CAATGGTA
46-90 : TTGCTTTCTCCAGTGACCCTAAA------------CAATGGTA
```

FIGURE 3

FIGURE 4; GE0070 PbBCpf1 (A&B) and GE0075 PsphCpf1 (C&D)

FIGURE 4 cont'd; GE0070 PbBCpf1 (A&B) and GE0075 PsphCpf1 (C&D)

```
46-161  AGTGCAGCCATACAATCCCAGTCTCTGAAGAACTTCTGGTACCCAGTTGCTAGC CCAGTGACTGACCTAAAAGACAGCTG
WT      AGTGCAGCCATACAATCCCAGTCTCTGAAGAACTTCTGGTACCCAGTTGC TTC CCAGTGACTGACCTAAAAAGAC 46-161  AATTAACGCCGAATTAATTCGGGGGATCTGGATTTTAGTACTGGATTTTGG
WT
```

COMPOSITIONS AND METHODS FOR MODIFYING GENOMES

FIELD OF THE INVENTION

The present invention relates to compositions and methods for editing genomic sequences at pre-selected locations and for modulating gene expression.

REFERENCE TO A SEQUENCE LISTING SUBMITTED AS A TEXT FILE VIA EFS-WEB

The official copy of the sequence listing is submitted concurrently with the specification as a text file via EFS-Web, in compliance with the American Standard Code for Information Interchange (ASCII), with a file name of [B88552_1060US_0058_0_Seq List.txt, a creation date of Feb. 14, 2017, and a size of 1.62 MB. The sequence listing filed via EFS-Web is part of the specification and is hereby incorporated in its entirety by reference herein.

BACKGROUND OF THE INVENTION

Modification of genomic DNA is of immense importance for basic and applied research. Genomic modifications have the potential to elucidate and in some cases to cure the causes of disease and to provide desirable traits in the cells and/or individuals comprising said modifications. Genomic modification may include, for example, modification of plant, animal, fungal, and/or prokaryotic genomic modification. One area in which genomic modification is practiced is in the modification of plant genomic DNA.

Modification of plant genomic DNA is of immense importance to both basic and applied plant research. Transgenic plants with stably modified genomic DNA can have new traits such as herbicide tolerance, insect resistance, and/or accumulation of valuable proteins including pharmaceutical proteins and industrial enzymes imparted to them. The expression of native plant genes may be up- or down-regulated or otherwise altered (e.g., by changing the tissue(s) in which native plant genes are expressed), their expression may be abolished entirely, DNA sequences may be altered (e.g., through point mutations, insertions, or deletions), or new non-native genes may be inserted into a plant genome to impart new traits to the plant.

The most common methods for modifying plant genomic DNA tend to modify the DNA at random sites within the genome. Such methods include, for example, *Agrobacterium*-mediated plant transformation and biolistic transformation, also referred to as particle bombardment. In many cases, however, it is desirable to modify the genomic DNA at a pre-determined target site in the plant genome of interest, e.g., to avoid disruption of native plant genes or to insert a transgene cassette at a genomic locus that is known to provide robust gene expression. Only recently have technologies for targeted modification of plant genomic DNA become available. Such technologies rely on the creation of a double-stranded break (DSB) at the desired site. This DSB causes the recruitment of the plant's native DNA-repair machinery to the DSB. The DNA-repair machinery may be harnessed to insert heterologous DNA at a pre-determined site, to delete native plant genomic DNA, or to produce point mutations, insertions, or deletions at a desired site.

SUMMARY OF THE INVENTION

Compositions and methods for modifying genomic DNA sequences are provided. As used herein, genomic DNA refers to linear and/or chromosomal DNA and/or to plasmid or other extrachromosomal DNA sequences present in the cell or cells of interest. The methods produce double-stranded breaks (DSBs) at pre-determined target sites in a genomic DNA sequence, resulting in mutation, insertion, and/or deletion of DNA sequences at the target site(s) in a genome. Compositions comprise DNA constructs comprising nucleotide sequences that encode a Cpf1 or Csm1 protein operably linked to a promoter that is operable in the cells of interest. The DNA constructs can be used to direct the modification of genomic DNA at pre-determined genomic loci. Methods to use these DNA constructs to modify genomic DNA sequences are described herein. Modified plants, plant cells, plant parts and seeds are also encompassed. Compositions and methods for modulating the expression of genes are also provided. The methods target protein(s) to pre-determined sites in a genome to effect an up- or down-regulation of a gene or genes whose expression is regulated by the targeted site in the genome. Compositions comprise DNA constructs comprising nucleotide sequences that encode a modified Cpf1 or Csm1 protein with diminished or abolished nuclease activity, optionally fused to a transcriptional activation or repression domain. Methods to use these DNA constructs to modify gene expression are described herein.

BRIEF DESCRIPTION OF THE DRAWINGS

FIG. 2A shows the results of an insertion of an hph cassette at the CAO1 locus. The PAM sequence is boxed and the sequence targeted by the guide RNA is underlined. The ellipsis indicates that a large insertion existed, but the full sequence data is not shown here. FIGS. 2B, 2C, and 2D show data obtained from rice calli in which an FnCpf1-mediated deletion event occurred in Experiment 01 (Table 7). In FIGS. 2B and 2C, the lanes depict callus pieces #1-16, from left to right, followed by a molecular weight ladder lane. FIG. 2B shows PCR amplification of the FnCpf1 gene cassette, indicating insertion of this cassette in the rice genome in callus pieces 1, 2, 4, 6, 7, and 15. FIG. 2C shows the results of a T7EI assay with DNA extracted from these same callus pieces, with the double-band pattern for callus #15 indicating a possible insertion or deletion. Similar T7EI assay results were obtained for additional calli in a repeat of Experiment 01, which resulted in the production of callus pieces 01-20, 01-21, 01-30, and 01-31. FIG. 2D shows an alignment of sequence data obtained from callus #15 (01-15), along with the sequence data from callus pieces 01-20, 01-21, 01-30, and 01-31. The PAM sequence is boxed and the sequence targeted by the guide RNA is underlined.

FIG. 3A shows an alignment of the wild-type rice CAO1 locus with sequence data from callus piece #21 from Experiment 31 (31-21), callus piece #33 from Experiment 80 (80-33), callus pieces 9, 30, and 46 from Experiment 81 (81-09, 81-30, and 81-46, respectively), callus piece #47 from Experiment 93 (93-47), callus piece #4 from Experiment 91 (91-04), callus pieces #112 and 141 from Experiment 97 (97-112 and 97-141), and callus pieces #4 and 11 from Experiment 119 (119-04 and 119-11). FIG. 3B shows sequence data from callus pieces 46-38, 46-77, 46-86, 46-88, and 46-90 from Experiment 46. In both 4A and 4B, the PAM site is boxed and the region targeted by the guide RNA is underlined.

FIG. 4A shows a schematic overview of a portion of the 131633 plasmid including the homologous regions of the 35S terminator and the downstream arm that led to the recombination events recovered from Experiment 70. Regions of homology that appear to have mediated the unintended HDR events are underlined. FIG. 4B shows the sequencing data from callus piece 70-15. WT, wild-type sequence; GE70, callus piece 70-15 sequence; 131633_upstream, upstream arm and 35S Term sequence from plasmid 131633; 131633_downstream, downstream arm sequence from plasmid 131633. FIG. 4C shows a schematic overview of a portion of the 131633 plasmid including the homologous regions of the 35S terminator and the downstream arm that led to the recombination events recovered from experiment 75. Regions of homology that appear to have mediated the unintended HDR events are underlined. FIG. 4D shows the sequencing data from callus piece 75-46. WT, wild-type sequence; GE75, callus piece 75-46 sequence; 131633_upstream, upstream arm and 35S Term sequence from plasmid 131633; 131633_downstream, downstream arm sequence from plasmid 131633. 35S Term, CaMV 35S terminator; hph, hygromycin phosphotransferase coding region; pZmUbi, maize ubiquitin promoter. In FIGS. 4B and 4D, the PAM site is boxed.

FIG. 5 shows the sequence of the upstream region of callus piece #46-161 from Experiment 46 (Table 7). The PAM site is boxed, showing the expected mutation of this site in the transformed rice callus, and the sequence data indicates successful insertion of the vector 131633 insert at the rice CAO1 genomic locus.

DETAILED DESCRIPTION OF THE INVENTION

Figure 1:
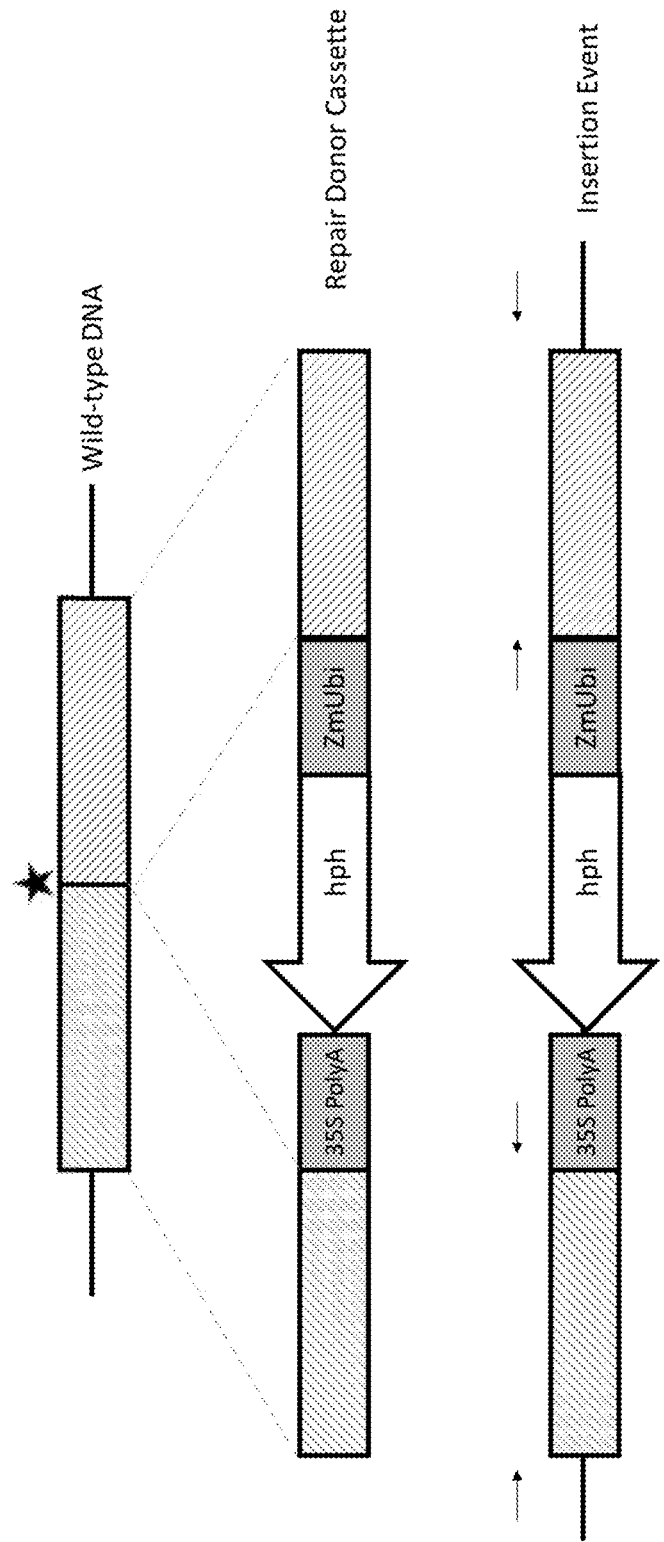
FIG. 1 shows a schematic depiction of the insertion of a hygromycin resistance gene cassette in the rice CAO1 genomic locus. The star indicates the site of the intended Cpf1-mediated double-stranded break in the wild-type DNA. Dashed lines indicate homology between the repair donor cassette and wild-type DNA. Small arrows indicate the primer binding sites for the PCR reactions used to verify insertion at the intended genomic locus. 35S Term., CaMV 35S terminator; hph, hygromycin resistance gene; ZmUbi, maize ubiquitin promoter.

Methods and compositions are provided herein for the control of gene expression involving sequence targeting, such as genome perturbation or gene-editing, that relate to the CRISPR-Cpf or CRISPR-Csm system and components thereof. In certain embodiments, the CRISPR enzyme is a Cpf enzyme, e.g. a Cpf1 ortholog. In certain embodiments, the CRISPR enzyme is a Csm enzyme, e.g. a Csm1 ortholog. The methods and compositions include nucleic acids to bind target DNA sequences. This is advantageous as nucleic acids are much easier and less expensive to produce than, for example, peptides, and the specificity can be varied according to the length of the stretch where homology is sought. Complex 3-D positioning of multiple fingers, for example is not required.

Also provided are nucleic acids encoding the Cpf1 and Csm1 polypeptides, as well as methods of using Cpf1 and Csm1 polypeptides to modify chromosomal (i.e., genomic) or organellar DNA sequences of host cells including plant cells. The Cpf1 polypeptides interact with specific guide RNAs (gRNAs), which direct the Cpf1 or Csm1 endonuclease to a specific target site, at which site the Cpf1 or Csm1 endonuclease introduces a double-stranded break that can be repaired by a DNA repair process such that the DNA sequence is modified. Since the specificity is provided by the guide RNA, the Cpf1 or Csm1 polypeptide is universal and can be used with different guide RNAs to target different genomic sequences. Cpf1 and Csm1 endonucleases have certain advantages over the Cas nucleases (e.g., Cas9) traditionally used with CRISPR arrays. For example, Cpf1-associated CRISPR arrays are processed into mature crRNAs without the requirement of an additional trans-activating crRNA (tracrRNA). Also, Cpf1-crRNA complexes can cleave target DNA preceded by a short protospacer-adjacent motif (PAM) that is often T-rich, in contrast to the G-rich PAM following the target DNA for many Cas9 systems. Further, Cpf1 can introduce a staggered DNA double-stranded break with a 4 or 5-nucleotide (nt) 5' overhang. Without being limited by theory, it is likely that Csm1 proteins similarly process their CRISPR arrays into mature crRNAs without the requirement of an additional trans-activating crRNA (tracrRNA) and produce staggered rather than blunt cuts. The methods disclosed herein can be used to target and modify specific chromosomal sequences and/or introduce exogenous sequences at targeted locations in the genome of plant cells or plant embryos. The methods can further be used to introduce sequences or modify regions within organelles (e.g., chloroplasts and/or mitochondria). Furthermore, the targeting is specific with limited off target effects.

I. Cpf1 and Csm1 Endonucleases

Provided herein are Cpf1 and Csm1 endonucleases, and fragments and variants thereof, for use in modifying genomes including plant genomes. As used herein, the term Cpf1 endonucleases or Cpf1 polypeptides refers to homologs and orthologs of the Cpf1 polypeptides disclosed in Zetsche et al. (2015) Cell 163: 759-771 and of the Cpf1 polypeptides disclosed in U.S. Patent Application 2016/0208243, and fragments and variants thereof. Examples of Cpf1 polypeptides are set forth in SEQ ID NOs: 3, 6, 9, 12, 15, 18, 20, 23, 106-133, 135-146, 148-158, 161-173, and 231-236. As used herein, the term Csm1 endonucleases or Csm1 polypeptides refers to homologs and orthologs of SEQ ID NOs:134, 147, 159, 160, and 230. Typically, Cpf1 and Csm1 endonucleases can act without the use of tracrRNAs and can introduce a staggered DNA double-strand break. In general, Cpf1 and Csm1 polypeptides comprise at least one RNA recognition and/or RNA binding domain. RNA recognition and/or RNA binding domains interact with guide RNAs. Cpf1 and Csm1 polypeptides can also comprise nuclease domains (i.e., DNase or RNase domains), DNA binding domains, helicase domains, RNAse domains, protein-protein interaction domains, dimerization domains, as well as other domains. In specific embodiments, a Cpf1 or Csm1 polypeptide, or a polynucleotide encoding a Cpf1 or Csm1 polypeptide, comprises: an RNA-binding portion that interacts with the DNA-targeting RNA, and an activity portion that exhibits site-directed enzymatic activity, such as a RuvC endonuclease domain.

Cpf1 or Csm1 polypeptides can be wild type Cpf1 or Csm1 polypeptide, modified Cpf1 or Csm1 polypeptides, or a fragment of a wild type or modified Cpf1 or Csm1 polypeptide. The Cpf1 or Csm1 polypeptide can be modified to increase nucleic acid binding affinity and/or specificity, alter an enzymatic activity, and/or change another property of the protein. For example, nuclease (i.e., DNase, RNase) domains of the Cpf1 or Csm1 polypeptide can be modified, deleted, or inactivated. Alternatively, the Cpf1 or Csm1 polypeptide can be truncated to remove domains that are not essential for the function of the protein. In specific embodiments, the Cpf1 or Csm1 polypeptide forms a homodimer or a heterodimer.

In some embodiments, the Cpf1 or Csm1 polypeptide can be derived from a wild type Cpf1 or Csm1 polypeptide or fragment thereof. In other embodiments, the Cpf1 or Csm1 polypeptide can be derived from a modified Cpf1 or Csm1 polypeptide. For example, the amino acid sequence of the Cpf1 or Csm1 polypeptide can be modified to alter one or more properties (e.g., nuclease activity, affinity, stability, etc.) of the protein. Alternatively, domains of the Cpf1 or Csm1 polypeptide not involved in RNA-guided cleavage can be eliminated from the protein such that the modified Cpf1 or Csm1 polypeptide is smaller than the wild type Cpf1 or Csm1 polypeptide.

In general, a Cpf1 or Csm1 polypeptide comprises at least one nuclease (i.e., DNase) domain, but need not contain an HNH domain such as the one found in Cas9 proteins. For example, a Cpf1 or Csm1 polypeptide can comprise a RuvC-like nuclease domain. In some embodiments, the Cpf1 or Csm1 polypeptide can be modified to inactivate the nuclease domain so that it is no longer functional. In some embodiments in which one of the nuclease domains is inactive, the Cpf1 or Csm1 polypeptide does not cleave double-stranded DNA. In specific embodiments, the mutated Cpf1 or Csm1 polypeptide comprises a mutation in a position corresponding to positions 917 or 1006 of FnCpf1 (SEQ ID NO: 3) or to positions 701 or 922 of SmCsm1 (SEQ ID NO:160) when aligned for maximum identity that reduces or eliminates the nuclease activity. For example, an aspartate to alanine (D917A) conversion and glutamate to alanine (E1006A) in a RuvC-like domain completely inactivated the DNA cleavage activity of FnCpf1 (SEQ ID NO: 3), while aspartate to alanine (D1255A) significantly reduced cleavage activity (Zetsche et al. (2015) *Cell* 163: 759-771). The nuclease domain can be modified using well-known methods, such as site-directed mutagenesis, PCR-mediated mutagenesis, and total gene synthesis, as well as other methods known in the art. Cpf1 or Csm1 proteins with inactivated nuclease domains (dCpf1 or dCsm1 proteins) can be used to modulate gene expression without modifying DNA sequences. In certain embodiments, a dCpf1 or dCsm1 protein may be targeted to particular regions of a genome such as promoters for a gene or genes of interest through the use of appropriate gRNAs. The dCpf1 or dCsm1 protein can bind to the desired region of DNA and may interfere with RNA polymerase binding to this region of DNA and/or with the binding of transcription factors to this region of DNA. This technique may be used to up- or down-regulate the expression of one or more genes of interest. In certain other embodiments, the dCpf1 or dCsm1 protein may be fused to a repressor domain to further downregulate the expression of a gene or genes whose expression is regulated by interactions of RNA polymerase, transcription factors, or other transcriptional regulators with the region of chromosomal DNA targeted by the gRNA. In certain other embodiments, the dCpf1 or dCsm1 protein may be fused to an activation domain to effect an upregulation of a gene or genes whose expression is regulated by interactions of RNA polymerase, transcription factors, or other transcriptional regulators with the region of chromosomal DNA targeted by the gRNA.

The Cpf1 and Csm1 polypeptides disclosed herein can further comprise at least one nuclear localization signal (NLS). In general, an NLS comprises a stretch of basic amino acids. Nuclear localization signals are known in the art (see, e.g., Lange et al., *J. Biol. Chem.* (2007) 282:5101-5105). The NLS can be located at the N-terminus, the C-terminus, or in an internal location of the Cpf1 or Csm1 polypeptide. In some embodiments, the Cpf1 or Csm1 polypeptide can further comprise at least one cell-penetrating domain. The cell-penetrating domain can be located at the N-terminus, the C-terminus, or in an internal location of the protein.

The Cpf1 or Csm1 polypeptide disclosed herein can further comprise at least one plastid targeting signal peptide, at least one mitochondrial targeting signal peptide, or a signal peptide targeting the Cpf1 or Csm1 polypeptide to both plastids and mitochondria. Plastid, mitochondrial, and dual-targeting signal peptide localization signals are known in the art (see, e.g., Nassoury and Morse (2005) *Biochim Biophys Acta* 1743:5-19; Kunze and Berger (2015) *Front Physiol* dx.doi.org/10.3389/fphys.2015.00259; Herrmann and Neupert (2003) *IUBMB Life* 55:219-225; Soll (2002) *Curr Opin Plant Biol* 5:529-535; Carrie and Small (2013) *Biochim Biophys Acta* 1833:253-259; Carrie et al. (2009) *FEBS J* 276:1187-1195; Silva-Filho (2003) *Curr Opin Plant Biol* 6:589-595; Peeters and Small (2001) *Biochim Biophys Acta* 1541:54-63; Murcha et al. (2014) *J Exp Bot* 65:6301-6335; Mackenzie (2005) *Trends Cell Biol* 15:548-554; Glaser et al. (1998) *Plant Mol Biol* 38:311-338). The plastid, mitochondrial, or dual-targeting signal peptide can be located at the N-terminus, the C-terminus, or in an internal location of the Cpf1 or Csm1 polypeptide.

In still other embodiments, the Cpf1 or Csm1 polypeptide can also comprise at least one marker domain. Non-limiting examples of marker domains include fluorescent proteins, purification tags, and epitope tags. In certain embodiments, the marker domain can be a fluorescent protein. Non limiting examples of suitable fluorescent proteins include green fluorescent proteins (e.g., GFP, GFP-2, tagGFP, turboGFP, EGFP, Emerald, Azami Green, Monomeric Azami Green, CopGFP, AceGFP, ZsGreen1), yellow fluorescent proteins (e.g. YFP, EYFP, Citrine, Venus, YPet, PhiYFP, ZsYellow1), blue fluorescent proteins (e.g. EBFP, EBFP2, Azurite, mKalama1, GFPuv, Sapphire, T-sapphire), cyan fluorescent proteins (e.g. ECFP, Cerulean, CyPet, AmCyan1, Midoriishi-Cyan), red fluorescent proteins (mKate, mKate2, mPlum, DsRed monomer, mCherry, mRFP1, DsRed-Express, DsRed2, DsRed-Monomer, HcRed-Tandem, HcRed1, AsRed2, eqFP611, mRasberry, mStrawberry, Jred), and orange fluorescent proteins (mOrange, mKO, Kusabira-Orange, Monomeric Kusabira-Orange, mTangerine, tdTomato) or any other suitable fluorescent protein. In other embodiments, the marker domain can be a purification tag and/or an epitope tag. Exemplary tags include, but are not limited to, glutathione-S-transferase (GST), chitin binding protein (CBP), maltose binding protein, thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, S1, T7, V5, VSV-G, 6×His, biotin carboxyl carrier protein (BCCP), and calmodulin.

In certain embodiments, the Cpf1 or Csm1 polypeptide may be part of a protein-RNA complex comprising a guide RNA. The guide RNA interacts with the Cpf1 or Csm1 polypeptide to direct the Cpf1 or Csm1 polypeptide to a specific target site, wherein the 5' end of the guide RNA can base pair with a specific protospacer sequence of the nucleotide sequence of interest in the plant genome, whether part of the nuclear, plastid, and/or mitochondrial genome. As used herein, the term "DNA-targeting RNA" refers to a guide RNA that interacts with the Cpf1 or Csm1 polypeptide and the target site of the nucleotide sequence of interest in the genome of a plant cell. A DNA-targeting RNA, or a DNA polynucleotide encoding a DNA-targeting RNA, can comprise: a first segment comprising a nucleotide sequence that is complementary to a sequence in the target DNA, and a second segment that interacts with a Cpf1 or Csm1 polypeptide.

The polynucleotides encoding Cpf1 and Csm1 polypeptides disclosed herein can be used to isolate corresponding sequences from other prokaryotic or eukaryotic organisms. In this manner, methods such as PCR, hybridization, and the like can be used to identify such sequences based on their sequence homology or identity to the sequences set forth herein. Sequences isolated based on their sequence identity to the entire Cpf1 or Csm1 sequences set forth herein or to variants and fragments thereof are encompassed by the present invention. Such sequences include sequences that are orthologs of the disclosed Cpf1 and Csm1 sequences. "Orthologs" is intended to mean genes derived from a common ancestral gene and which are found in different species as a result of speciation. Genes found in different species are considered orthologs when their nucleotide sequences and/or their encoded protein sequences share at least about 75%, about 80%, about 85%, about 90%, about 91%, about 92%, about 93%, about 94%, about 95%, about 96%, about 97%, about 98%, about 99%, or greater sequence identity. Functions of orthologs are often highly conserved among species. Thus, isolated polynucleotides that encode polypeptides having Cpf1 or Csm1 endonuclease activity and which share at least about 75% or more sequence identity to the sequences disclosed herein, are encompassed by the present invention. As used herein, Cpf1 or Csm1 endonuclease activity refers to CRISPR endonuclease activity wherein, a guide RNA (gRNA) associated with a Cpf1 or Csm1 polypeptide causes the Cpf1-gRNA or Csm1-gRNA complex to bind to a pre-determined nucleotide sequence that is complementary to the gRNA; and wherein Cpf1 or Csm1 activity can introduce a double-stranded break at or near the site targeted by the gRNA. In certain embodiments, this double-stranded break may be a staggered DNA double-stranded break. As used herein a "staggered DNA double-stranded break" can result in a double strand break with about 1, about 2, about 3, about 4, about 5, about 6, about 7, about 8, about 9, or about 10 nucleotides of overhang on either the 3' or 5' ends following cleavage. In specific embodiments, the Cpf1 or Csm1 polypeptide introduces a staggered DNA double-stranded break with a 4 or 5-nt 5' overhang. The double strand break can occur at or near the sequence to which the DNA-targeting RNA (e.g., guide RNA) sequence is targeted.

Fragments and variants of the Cpf1 and Csm1 polynucleotides and Cpf1 and Csm1 amino acid sequences encoded thereby are encompassed herein. By "fragment" is intended a portion of the polynucleotide or a portion of the amino acid sequence. "Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. Generally, variants of a particular polynucleotide of the invention will have at least about 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein.

"Variant" amino acid or protein is intended to mean an amino acid or protein derived from the native amino acid or protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins encompassed by the present invention are biologically active, that is they continue to possess the desired biological activity of the native protein. Biologically active variants of a native polypeptide will have at least about 80%, 85%, 90%, 91%, 92%, 93%, 94%, 95%, 96%, 97%, 98%, 99% or more sequence identity to the amino acid sequence for the native sequence as determined by sequence alignment programs and parameters described herein. A biologically active variant of a protein of the invention may differ from that protein by as few as 1-15 amino acid residues, as few as 1-10, such as 6-10, as few as 5, as few as 4, 3, 2, or even 1 amino acid residue.

Variant sequences may also be identified by analysis of existing databases of sequenced genomes. In this manner, corresponding sequences can be identified and used in the methods of the invention.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244; Higgins et al. (1989) *CABIOS* 5:151-153; Corpet et al. (1988) *Nucleic Acids Res.* 16:10881-90; Huang et al. (1992) *CABIOS* 8:155-65; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See the website at www.ncbi.nlm.nih.gov. Alignment may also be performed manually by inspection.

The nucleic acid molecules encoding Cpf1 and Csm1 polypeptides, or fragments or variants thereof, can be codon optimized for expression in a plant of interest or other cell or organism of interest. A "codon-optimized gene" is a gene having its frequency of codon usage designed to mimic the frequency of preferred codon usage of the host cell. Nucleic acid molecules can be codon optimized, either wholly or in part. Because any one amino acid (except for methionine and tryptophan) is encoded by a number of codons, the sequence of the nucleic acid molecule may be changed without changing the encoded amino acid. Codon optimization is when one or more codons are altered at the nucleic acid level such that the amino acids are not changed but expression in a particular host organism is increased. Those having ordinary skill in the art will recognize that codon tables and other references providing preference information for a wide range of organisms are available in the art (see, e.g., Zhang et al. (1991) *Gene* 105:61-72; Murray et al. (1989) *Nucl. Acids Res.* 17:477-508). Methodology for optimizing a nucleotide sequence for expression in a plant is provided, for example, in U.S. Pat. No. 6,015,891, and the references cited therein. Example of codon optimized polynucleotides for expression in a plant are set forth in: SEQ ID NOs: 5, 8, 11, 14, 17, 19, 22, 25, and 174-206.

II. Fusion Proteins

Fusion proteins are provided herein comprising a Cpf1 or Csm1 polypeptide, or a fragment or variant thereof, and an effector domain. The Cpf1 or Csm1 polypeptide can be directed to a target site by a guide RNA, at which site the effector domain can modify or effect the targeted nucleic acid sequence. The effector domain can be a cleavage domain, an epigenetic modification domain, a transcriptional activation domain, or a transcriptional repressor domain. The fusion protein can further comprise at least one additional domain chosen from a nuclear localization signal, plastid signal peptide, mitochondrial signal peptide, signal peptide capable of protein trafficking to multiple subcellular locations, a cell-penetrating domain, or a marker domain, any of which can be located at the N-terminus, C-terminus, or an internal location of the fusion protein. The Cpf1 or Csm1 polypeptide can be located at the N-terminus, the C-terminus, or in an internal location of the fusion protein. The Cpf1 or Csm1 polypeptide can be directly fused to the effector domain, or can be fused with a linker. In specific embodiments, the linker sequence fusing the Cpf1 or Csm1 polypeptide with the effector domain can be at least 1, 2, 3, 4, 5, 6, 7, 8, 9, 10, 15, 20, 25, 30, 40, or 50 amino acids in length. For example, the linker can range from 1-5, 1-10, 1-20, 1-50, 2-3, 3-10, 3-20, 5-20, or 10-50 amino acids in length.

In some embodiments, the Cpf1 or Csm1 polypeptide of the fusion protein can be derived from a wild type Cpf1 or Csm1 protein. The Cpf1-derived or Csm1-derived protein can be a modified variant or a fragment. In some embodiments, the Cpf1 or Csm1 polypeptide can be modified to contain a nuclease domain (e.g. a RuvC-like domain) with reduced or eliminated nuclease activity. For example, the Cpf1-derived or Csm1-derived polypeptide can be modified such that the nuclease domain is deleted or mutated such that it is no longer functional (i.e., the nuclease activity is absent). Particularly, a Cpf1 or Csm1 polypeptide can have a mutation in a position corresponding to positions 917 or 1006 of FnCpf1 (SEQ ID NO:3) or to positions 701 or 922 of SmCsm1 (SEQ ID NO:160) when aligned for maximum identity. For example, an aspartate to alanine (D917A) conversion and glutamate to alanine (E1006A) in a RuvC-like domain completely inactivated the DNA cleavage activity of FnCpf1, while aspartate to alanine (D1255A) significantly reduced cleavage activity (Zetsche et al. (2015) *Cell* 163: 759-771). Examples of Cpf1 polypeptides having mutations in the RuvC domain are set forth in SEQ ID NOs: 26-41 and 63-70. The nuclease domain can be inactivated by one or more deletion mutations, insertion mutations, and/or substitution mutations using known methods, such as site-directed mutagenesis, PCR-mediated mutagenesis, and total gene synthesis, as well as other methods known in the art. In an exemplary embodiment, the Cpf1 or Csm1 polypeptide of the fusion protein is modified by mutating the RuvC-like domain such that the Cpf1 or Csm1 polypeptide has no nuclease activity.

The fusion protein also comprises an effector domain located at the N-terminus, the C-terminus, or in an internal location of the fusion protein. In some embodiments, the effector domain is a cleavage domain. As used herein, a "cleavage domain" refers to a domain that cleaves DNA. The cleavage domain can be obtained from any endonuclease or exonuclease. Non-limiting examples of endonucleases from which a cleavage domain can be derived include, but are not limited to, restriction endonucleases and homing endonucleases. See, for example, New England Biolabs Catalog or Belfort et al. (1997) *Nucleic Acids Res.* 25:3379-3388. Additional enzymes that cleave DNA are known (e.g., 51 Nuclease; mung bean nuclease; pancreatic DNase I; micrococcal nuclease; yeast HO endonuclease). See also Linn et al. (eds.) Nucleases, Cold Spring Harbor Laboratory Press, 1993. One or more of these enzymes (or functional fragments thereof) can be used as a source of cleavage domains.

In some embodiments, the cleavage domain can be derived from a type II-S endonuclease. Type II-S endonucleases cleave DNA at sites that are typically several base pairs away from the recognition site and, as such, have separable recognition and cleavage domains. These enzymes generally are monomers that transiently associate to form dimers to cleave each strand of DNA at staggered locations. Non-limiting examples of suitable type II-S endonucleases include BfiI, BpmI, BsaI, BsgI, BsmBI, BsmI, BspMI, FokI, MboII, and SapI.

In certain embodiments, the type II-S cleavage can be modified to facilitate dimerization of two different cleavage domains (each of which is attached to a Cpf1 or Csm1 polypeptide or fragment thereof). In embodiments wherein the effector domain is a cleavage domain the Cpf1 or Csm1 polypeptide can be modified as discussed herein such that its endonuclease activity is eliminated. For example, the Cpf1 or Csm1 polypeptide can be modified by mutating the RuvC-like domain such that the polypeptide no longer exhibits endonuclease activity.

In other embodiments, the effector domain of the fusion protein can be an epigenetic modification domain. In general, epigenetic modification domains alter histone structure and/or chromosomal structure without altering the DNA sequence. Changes in histone and/or chromatin structure can lead to changes in gene expression. Examples of epigenetic modification include, without limit, acetylation or methylation of lysine residues in histone proteins, and methylation of cytosine residues in DNA. Non-limiting examples of suitable epigenetic modification domains include histone acetyltansferase domains, histone deacetylase domains, histone methyltransferase domains, histone demethylase domains, DNA methyltransferase domains, and DNA demethylase domains.

In embodiments in which the effector domain is a histone acetyltransferase (HAT) domain, the HAT domain can be derived from EP300 (i.e., E1A binding protein p300), CREBBP (i.e., CREB-binding protein), CDY1, CDY2, CDYL1, CLOCK, ELP3, ESA1, GCN5 (KAT2A), HAT1, KAT2B, KAT5, MYST1, MYST2, MYST3, MYST4, NCOA1, NCOA2, NCOA3, NCOAT, P/CAF, Tip60, TAFII250, or TF3C4. In embodiments wherein the effector domain is an epigenetic modification domain, the Cpf1 or Csm1 polypeptide can be modified as discussed herein such that its endonuclease activity is eliminated. For example, the Cpf1 or Csm1 polypeptide can be modified by mutating the RuvC-like domain such that the polypeptide no longer possesses nuclease activity.

In some embodiments, the effector domain of the fusion protein can be a transcriptional activation domain. In general, a transcriptional activation domain interacts with transcriptional control elements and/or transcriptional regulatory proteins (i.e., transcription factors, RNA polymerases, etc.) to increase and/or activate transcription of one or more genes. In some embodiments, the transcriptional activation domain can be, without limit, a herpes simplex virus VP16 activation domain, VP64 (which is a tetrameric derivative of VP16), a NFκB p65 activation domain, p53 activation domains 1 and 2, a CREB (cAMP response element binding protein) activation domain, an E2A activation domain, and an NFAT (nuclear factor of activated T-cells) activation domain. In other embodiments, the transcriptional activation domain can be Gal4, Gcn4, MLL, Rtg3, Gln3, Oaf1, Pip2, Pdr1, Pdr3, Pho4, and Leu3. The transcriptional activation domain may be wild type, or it may be a modified version of the original transcriptional activation domain. In some embodiments, the effector domain of the fusion protein is a VP16 or VP64 transcriptional activation domain. In embodiments wherein the effector domain is a transcriptional activation domain, the Cpf1 or Csm1 polypeptide can be modified as discussed herein such that its endonuclease activity is eliminated. For example, the Cpf1 or Csm1 polypeptide can be modified by mutating the RuvC-like domain such that the polypeptide no longer possesses nuclease activity.

In still other embodiments, the effector domain of the fusion protein can be a transcriptional repressor domain. In general, a transcriptional repressor domain interacts with transcriptional control elements and/or transcriptional regulatory proteins (i.e., transcription factors, RNA polymerases, etc.) to decrease and/or terminate transcription of one or more genes. Non-limiting examples of suitable transcriptional repressor domains include inducible cAMP early repressor (ICER) domains, Kruppel-associated box A (KRAB-A) repressor domains, YY1 glycine rich repressor domains, Sp1-like repressors, E(spl) repressors, I.kappa.B repressor, and MeCP2. In embodiments wherein the effector domain is a transcriptional repressor domain, the Cpf1 or Csm1 polypeptide can be modified as discussed herein such that its endonuclease activity is eliminated. For example, the Cpf1 or Csm1 polypeptide can be modified by mutating the RuvC-like domain such that the polypeptide no longer possesses nuclease activity.

In some embodiments, the fusion protein further comprises at least one additional domain. Non-limiting examples of suitable additional domains include nuclear localization signals, cell-penetrating or translocation domains, and marker domains.

When the effector domain of the fusion protein is a cleavage domain, a dimer comprising at least one fusion protein can form. The dimer can be a homodimer or a heterodimer. In some embodiments, the heterodimer comprises two different fusion proteins. In other embodiments, the heterodimer comprises one fusion protein and an additional protein.

The dimer can be a homodimer in which the two fusion protein monomers are identical with respect to the primary amino acid sequence. In one embodiment where the dimer is a homodimer, the Cpf1 or Csm1 polypeptide can be modified such that the endonuclease activity is eliminated. In certain embodiments wherein the Cpf1 or Csm1 polypeptide is modified such that endonuclease activity is eliminated, each fusion protein monomer can comprise an identical Cpf1 or Csm1 polypeptide and an identical cleavage domain. The cleavage domain can be any cleavage domain, such as any of the exemplary cleavage domains provided herein. In such embodiments, specific guide RNAs would direct the fusion protein monomers to different but closely adjacent sites such that, upon dimer formation, the nuclease domains of the two monomers would create a double stranded break in the target DNA.

The dimer can also be a heterodimer of two different fusion proteins. For example, the Cpf1 or Csm1 polypeptide of each fusion protein can be derived from a different Cpf1 or Csm1 polypeptide or from an orthologous Cpf1 or Csm1 polypeptide from a different bacterial species. For example, each fusion protein can comprise a Cpf1 or Csm1 polypeptide derived from a different bacterial species. In these embodiments, each fusion protein would recognize a different target site (i.e., specified by the protospacer and/or PAM sequence). For example, the guide RNAs could position the heterodimer to different but closely adjacent sites such that their nuclease domains produce an effective double stranded break in the target DNA.

Alternatively, two fusion proteins of a heterodimer can have different effector domains. In embodiments in which the effector domain is a cleavage domain, each fusion protein can contain a different modified cleavage domain. In these embodiments, the Cpf1 or Csm1 polypeptide can be modified such that their endonuclease activities are eliminated. The two fusion proteins forming a heterodimer can differ in both the Cpf1 or Csm1 polypeptide domain and the effector domain.

In any of the above-described embodiments, the homodimer or heterodimer can comprise at least one additional domain chosen from nuclear localization signals (NLSs), plastid signal peptides, mitochondrial signal peptides, signal peptides capable of trafficking proteins to multiple subcellular locations, cell-penetrating, translocation domains and marker domains, as detailed above. In any of the above-described embodiments, one or both of the Cpf1 or Csm1 polypeptides can be modified such that endonuclease activity of the polypeptide is eliminated or modified.

The heterodimer can also comprise one fusion protein and an additional protein. For example, the additional protein can be a nuclease. In one embodiment, the nuclease is a zinc finger nuclease. A zinc finger nuclease comprises a zinc finger DNA binding domain and a cleavage domain. A zinc finger recognizes and binds three (3) nucleotides. A zinc finger DNA binding domain can comprise from about three zinc fingers to about seven zinc fingers. The zinc finger DNA binding domain can be derived from a naturally occurring protein or it can be engineered. See, for example, Beerli et al. (2002) *Nat. Biotechnol.* 20:135-141; Pabo et al. (2001) *Ann. Rev. Biochem.* 70:313-340; Isalan et al. (2001) *Nat. Biotechnol.* 19:656-660; Segal et al. (2001) *Curr. Opin. Biotechnol.* 12:632-637; Choo et al. (2000) *Curr. Opin. Struct. Biol.* 10:411-416; Zhang et al. (2000) *J. Biol. Chem.* 275(43):33850-33860; Doyon et al. (2008) *Nat. Biotechnol.* 26:702-708; and Santiago et al. (2008) *Proc. Natl. Acad. Sci. USA* 105:5809-5814. The cleavage domain of the zinc finger nuclease can be any cleavage domain detailed herein. In some embodiments, the zinc finger nuclease can comprise at least one additional domain chosen from nuclear localization signals, plastid signal peptides, mitochondrial signal peptides, signal peptides capable of trafficking proteins to multiple subcellular locations, cell-penetrating or translocation domains, which are detailed herein.

In certain embodiments, any of the fusion proteins detailed above or a dimer comprising at least one fusion protein may be part of a protein-RNA complex comprising at least one guide RNA. A guide RNA interacts with the Cpf1 or Csm1 polypeptide of the fusion protein to direct the fusion protein to a specific target site, wherein the 5' end of the guide RNA base pairs with a specific protospacer sequence.

III. Nucleic Acids Encoding Cpf1 or Csm1 Polypeptides or Fusion Proteins

Nucleic acids encoding any of the Cpf1 and Csm1 polypeptides or fusion proteins described herein are provided. The nucleic acid can be RNA or DNA. Examples of polynucleotides that encode Cpf1 polypeptides are set forth in SEQ ID NOs: 4, 5, 7, 8, 10, 11, 13, 14, 16, 17, 19, 21, 22, 24, 25, and 174-184, 187-192, 194-201, and 203-206. Examples of polynucleotides that encode Csm1 polypeptides are set forth in SEQ ID NOs:185, 186, 193, and 202. In one embodiment, the nucleic acid encoding the Cpf1 or Csm1 polypeptide or fusion protein is mRNA. The mRNA can be 5' capped and/or 3' polyadenylated. In another embodiment, the nucleic acid encoding the Cpf1 or Csm1 polypeptide or fusion protein is DNA. The DNA can be present in a vector.

Nucleic acids encoding the Cpf1 or Csm1 polypeptide or fusion proteins can be codon optimized for efficient translation into protein in the plant cell of interest. Programs for codon optimization are available in the art (e.g., OPTIMIZER at genomes.urv.es/OPTIMIZER; OptimumGene™ from GenScript at www.genscript.com/codon_opt.html).

In certain embodiments, DNA encoding the Cpf1 or Csm1 polypeptide or fusion protein can be operably linked to at least one promoter sequence. The DNA coding sequence can be operably linked to a promoter control sequence for expression in a host cell of interest. In some embodiments, the host cell is a plant cell. "Operably linked" is intended to mean a functional linkage between two or more elements. For example, an operable linkage between a promoter and a coding region of interest (e.g., region coding for a Cpf1 or Csm1 polypeptide or guide RNA) is a functional link that allows for expression of the coding region of interest. Operably linked elements may be contiguous or non-contiguous. When used to refer to the joining of two protein coding regions, by operably linked is intended that the coding regions are in the same reading frame.

The promoter sequence can be constitutive, regulated, growth stage-specific, or tissue-specific. It is recognized that different applications can be enhanced by the use of different promoters in the nucleic acid molecules to modulate the timing, location and/or level of expression of the Cpf1 or Csm1 polypeptide and/or guide RNA. Such nucleic acid molecules may also contain, if desired, a promoter regulatory region (e.g., one conferring inducible, constitutive, environmentally- or developmentally-regulated, or cell- or tissue-specific/selective expression), a transcription initiation start site, a ribosome binding site, an RNA processing signal, a transcription termination site, and/or a polyadenylation signal.

In some embodiments, the nucleic acid molecules provided herein can be combined with constitutive, tissue-preferred, developmentally-preferred or other promoters for expression in plants. Examples of constitutive promoters functional in plant cells include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. If low level expression is desired, weak promoter(s) may be used. Weak constitutive promoters include, for example, the core promoter of the Rsyn7 promoter (WO 99/43838 and U.S. Pat. No. 6,072,050), the core 35S CaMV promoter, and the like. Other constitutive promoters include, for example, U.S. Pat. Nos. 5,608,149; 5,608,144; 5,604,121; 5,569,597; 5,466,785; 5,399,680; 5,268,463; and 5,608,142. See also, U.S. Pat. No. 6,177,611, herein incorporated by reference.

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the ERE promoter which is estrogen induced, and the Axig1 promoter which is auxin induced and tapetum specific but also active in callus (PCT US01/22169).

Examples of promoters under developmental control in plants include promoters that initiate transcription preferentially in certain tissues, such as leaves, roots, fruit, seeds, or flowers. A "tissue specific" promoter is a promoter that initiates transcription only in certain tissues. Unlike constitutive expression of genes, tissue-specific expression is the result of several interacting levels of gene regulation. As such, promoters from homologous or closely related plant species can be preferable to use to achieve efficient and reliable expression of transgenes in particular tissues. In some embodiments, the expression comprises a tissue-preferred promoter. A "tissue preferred" promoter is a promoter that initiates transcription preferentially, but not necessarily entirely or solely in certain tissues.

In some embodiments, the nucleic acid molecules encoding a Cpf1 or Csm1 polypeptide and/or guide RNA comprise a cell type specific promoter. A "cell type specific" promoter is a promoter that primarily drives expression in certain cell types in one or more organs. Some examples of plant cells in which cell type specific promoters functional in plants may be primarily active include, for example, BETL cells, vascular cells in roots, leaves, stalk cells, and stem cells. The nucleic acid molecules can also include cell type preferred promoters. A "cell type preferred" promoter is a promoter that primarily drives expression mostly, but not necessarily entirely or solely in certain cell types in one or more organs. Some examples of plant cells in which cell type preferred promoters functional in plants may be preferentially active include, for example, BETL cells, vascular cells in roots, leaves, stalk cells, and stem cells. The nucleic acid molecules described herein can also comprise seed-preferred promoters. In some embodiments, the seed-preferred promoters have expression in embryo sac, early embryo, early endosperm, aleurone, and/or basal endosperm transfer cell layer (BETL).

Examples of seed-preferred promoters include, but are not limited to, 27 kD gamma zein promoter and waxy promoter, Boronat, A. et al. (1986) *Plant Sci.* 47:95-102; Reina, M. et al. *Nucl. Acids Res.* 18(21):6426; and Kloesgen, R. B. et al. (1986) *Mol. Gen. Genet.* 203:237-244. Promoters that express in the embryo, pericarp, and endosperm are disclosed in U.S. Pat. No. 6,225,529 and PCT publication WO 00/12733. The disclosures for each of these are incorporated herein by reference in their entirety.

Promoters that can drive gene expression in a plant seed-preferred manner with expression in the embryo sac, early embryo, early endosperm, aleurone and/or basal endosperm transfer cell layer (BETL) can be used in the compositions and methods disclosed herein. Such promoters include, but are not limited to, promoters that are naturally linked to Zea mays early endosperm 5 gene, Zea mays early endosperm 1 gene, Zea mays early endosperm 2 gene, GRMZM2G124663, GRMZM2G006585, GRMZM2G120008, GRMZM2G157806, GRMZM2G176390, GRMZM2G472234, GRMZM2G138727, Zea mays CLAVATA1, Zea mays MRP1, Oryza sativa PR602, Oryza sativa PR9a, Zea mays BET1, Zea mays BETL-2, Zea mays BETL-3, Zea mays BETL-4, Zea mays BETL-9, Zea mays BETL-10, Zea mays MEG1, Zea mays TCCR1, Zea mays ASP1, Oryza sativa ASP1, Triticum durum PR60, Triticum durum PR91, Triticum durum GL7, AT3G10590, AT4G18870, AT4G21080, AT5G23650, AT3G05860, AT5G42910, AT2G26320, AT3G03260, AT5G26630, AtIPT4, AtIPT8, AtLEC2, LFAH12. Additional such promoters are described in U.S. Pat. Nos. 7,803,990, 8,049,000, 7,745,697, 7,119,251, 7,964,770, 7,847,160, 7,700,836, U.S. Patent Application Publication Nos. 20100313301, 20090049571, 20090089897, 20100281569, 20100281570, 20120066795, 20040003427; PCT Publication Nos. WO/1999/050427, WO/2010/129999, WO/2009/094704, WO/2010/019996 and WO/2010/147825, each of which is herein incorporated by reference in its entirety for all purposes. Functional variants or functional fragments of the promoters described herein can also be operably linked to the nucleic acids disclosed herein.

Chemical-regulated promoters can be used to modulate the expression of a gene through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression of an expression construct within a particular tissue. In certain embodiments, the tissue-preferred promoters may be active in plant tissue. Tissue-preferred promoters are known in the art. See, for example, Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590. In addition, the promoters of cab and rubisco can also be used. See, for example, Simpson et al. (1958) *EMBO J* 4:2723-2729 and Timko et al. (1988) *Nature* 318:57-58.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed rolC and rolD root-inducing genes of *Agrobacterium rhizogenes* (see *Plant Science* (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene, fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and rolIB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179. The phaseolin gene (Mural et al. (1983) *Science* 23:476-482 and Sengopta-Gopalen et al. (1988) *PNAS* 82:3320-3324. The promoter sequence can be wild type or it can be modified for more efficient or efficacious expression.

The nucleic acid sequences encoding the Cpf1 or Csm1 polypeptide or fusion protein can be operably linked to a promoter sequence that is recognized by a phage RNA polymerase for in vitro mRNA synthesis. In such embodiments, the in vitro-transcribed RNA can be purified for use in the methods of genome modification described herein. For example, the promoter sequence can be a T7, T3, or SP6 promoter sequence or a variation of a T7, T3, or SP6 promoter sequence. In some embodiments, the sequence encoding the Cpf1 or Csm1 polypeptide or fusion protein can be operably linked to a promoter sequence for in vitro expression of the Cpf1 or Csm1 polypeptide or fusion protein in plant cells. In such embodiments, the expressed protein can be purified for use in the methods of genome modification described herein.

In certain embodiments, the DNA encoding the Cpf1 or Csm1 polypeptide or fusion protein also can be linked to a polyadenylation signal (e.g., SV40 polyA signal and other signals functional in plants) and/or at least one transcriptional termination sequence. Additionally, the sequence encoding the Cpf1 or Csm1 polypeptide or fusion protein also can be linked to sequence encoding at least one nuclear localization signal, at least one plastid signal peptide, at least one mitochondrial signal peptide, at least one signal peptide capable of trafficking proteins to multiple subcellular locations, at least one cell-penetrating domain, and/or at least one marker domain, described elsewhere herein.

The DNA encoding the Cpf1 or Csm1 polypeptide or fusion protein can be present in a vector. Suitable vectors include plasmid vectors, phagemids, cosmids, artificial/mini-chromosomes, transposons, and viral vectors (e.g., lentiviral vectors, adeno-associated viral vectors, etc.). In one embodiment, the DNA encoding the Cpf1 or Csm1 polypeptide or fusion protein is present in a plasmid vector. Non-limiting examples of suitable plasmid vectors include pUC, pBR322, pET, pBluescript, pCAMBIA, and variants thereof. The vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like. Additional information can be found in "Current Protocols in Molecular Biology" Ausubel et al., John Wiley & Sons, New York, 2003 or "Molecular Cloning: A Laboratory Manual" Sambrook & Russell, Cold Spring Harbor Press, Cold Spring Harbor, N.Y., 3rd edition, 2001.

In some embodiments, the expression vector comprising the sequence encoding the Cpf1 or Csm1 polypeptide or fusion protein can further comprise a sequence encoding a guide RNA. The sequence encoding the guide RNA can be operably linked to at least one transcriptional control sequence for expression of the guide RNA in the plant or plant cell of interest. For example, DNA encoding the guide RNA can be operably linked to a promoter sequence that is recognized by RNA polymerase III (Pol III). Examples of suitable Pol III promoters include, but are not limited to, mammalian U6, U3, H1, and 7SL RNA promoters and rice U6 and U3 promoters.

IV. Methods for Modifying a Nucleotide Sequence in a Plant Genome

Methods are provided herein for modifying a nucleotide sequence of a plant cell, plant organelle, or plant embryo. The methods comprise introducing into a plant cell, organelle, or embryo, a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide and also introducing to the plant cell a Cpf1 or Csm1 polypeptide, or a polynucleotide encoding a Cpf1 or Csm1 polypeptide, wherein the a Cpf1 or Csm1 polypeptide comprises: (a) an RNA-binding portion that interacts with the DNA-targeting RNA; and (b) an activity portion that exhibits site-directed enzymatic activity. The plant cell or plant embryo can then be cultured under conditions in which the Cpf1 or Csm1 polypeptide is expressed and cleaves the nucleotide sequence. It is noted that the system described herein does not require the addition of exogenous $Mg^{2+}$ or any other ions. Finally, a plant cell or organelle comprising the modified nucleotide sequence can be selected.

In some embodiments, the method can comprise introducing one Cpf1 or Csm1 polypeptide (or encoding nucleic acid) and one guide RNA (or encoding DNA) into a plant cell, organelle, or embryo, wherein the Cpf1 or Csm1 polypeptide introduces one double-stranded break in the target nucleotide sequence of the plant chromosomal DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence of the plant, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cpf1 or Csm1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence of the plant or introduces an exogenous sequence into the nucleotide sequence of the plant cell, plant organelle, or plant embryo.

The methods disclosed herein can also comprise introducing two Cpf1 or Csm1 polypeptides (or encoding nucleic acids) and two guide RNAs (or encoding DNAs) into a plant cell, organelle, or plant embryo, wherein the Cpf1 or Csm1 polypeptides introduce two double-stranded breaks in the nucleotide sequence of the nuclear and/or organellar chromosomal DNA. The two breaks can be within several base pairs, within tens of base pairs, or can be separated by many thousands of base pairs. In embodiments in which an optional donor polynucleotide is not present, the resultant double-stranded breaks can be repaired by a non-homologous repair process such that the sequence between the two cleavage sites is lost and/or deletions of at least one nucleotide, insertions of at least one nucleotide, substitutions of at least one nucleotide, or combinations thereof can occur during the repair of the break(s). In embodiments in which an optional donor polynucleotide is present, the donor sequence in the donor polynucleotide can be exchanged with or integrated into the nucleotide sequence of the plant during repair of the double-stranded breaks by either a homology-based repair process (e.g., in embodiments in which the donor sequence is flanked by upstream and downstream sequences having substantial sequence identity with upstream and downstream sequences, respectively, of the targeted sites in the nucleotide sequence) or a non-homologous repair process (e.g., in embodiments in which the donor sequence is flanked by compatible overhangs).

By "altering" or "modulating" the expression level of a gene is intended that the expression of the gene is upregulated or downregulated. It is recognized that in some instances, plant growth and yield are increased by increasing the expression levels of one or more genes encoding proteins involved in photosynthesis, i.e. upregulating expression. Likewise, in some instances, plant growth and yield may be increased by decreasing the expression levels of one or more genes encoding proteins involved in photosynthesis, i.e. downregulating expression. Thus, the invention encompasses the upregulation or downregulation of one or more genes encoding proteins involved in photosynthesis using the Cpf1 or Csm1 polypeptides disclosed herein. Further, the methods include the upregulation of at least one gene encoding a protein involved in photosynthesis and the downregulation of at least one gene encoding a protein involved in photosynthesis in a plant of interest. By modulating the concentration and/or activity of at least one of the genes encoding a protein involved in photosynthesis in a transgenic plant is intended that the concentration and/or activity is increased or decreased by at least about 1%, about 5%, about 10%, about 20%, about 30%, about 40%, about 50%, about 60%, about 70%, about 80%, or about 90% or greater relative to a native control plant, plant part, or cell which did not have the sequence of the invention introduced.

Plant cells possess nuclear, plastid, and mitochondrial genomes. The compositions and methods of the present invention may be used to modify the sequence of the nuclear, plastid, and/or mitochondrial genome, or may be used to modulate the expression of a gene or genes encoded by the nuclear, plastid, and/or mitochondrial genome. Accordingly, by "chromosome" or "chromosomal" is intended the nuclear, plastid, or mitochondrial genomic DNA. "Genome" as it applies to plant cells encompasses not only chromosomal DNA found within the nucleus, but organelle DNA found within subcellular components (e.g., mitochondria or plastids) of the cell. Any nucleotide sequence of interest in a plant cell, organelle, or embryo can be modified using the methods described herein. In specific embodiments, the methods disclosed herein are used to modify a nucleotide sequence encoding an agronomically important trait, such as a plant hormone, plant defense protein, a nutrient transport protein, a biotic association protein, a desirable input trait, a desirable output trait, a stress resistance gene, a disease/pathogen resistance gene, a male sterility, a developmental gene, a regulatory gene, a gene involved in photosynthesis, a DNA repair gene, a transcriptional regulatory gene or any other polynucleotide and/or polypeptide of interest. Agronomically important traits such as oil, starch, and protein content can also be modified. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885, 802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) *Eur. J. Biochem.* 165:99-106, the disclosures of which are herein incorporated by reference.

Derivatives of coding sequences can be made using the methods disclosed herein to increase the level of preselected amino acids in the encoded polypeptide. For example, the gene encoding the barley high lysine polypeptide (BHL) is derived from barley chymotrypsin inhibitor, U.S. application Ser. No. 08/740,682, filed Nov. 1, 1996, and WO 98/20133, the disclosures of which are herein incorporated by reference. Other proteins include methionine-rich plant proteins such as from sunflower seed (Lilley et al. (1989) *Proceedings of the World Congress on Vegetable Protein Utilization in Human Foods and Animal Feedstuffs*, ed. Applewhite (American Oil Chemists Society, Champaign, Ill.), pp. 497-502; herein incorporated by reference); corn (Pedersen et al. (1986) *J. Biol. Chem.* 261:6279; Kirihara et al. (1988) *Gene* 71:359; both of which are herein incorporated by reference); and rice (Musumura et al. (1989) *Plant Mol. Biol.* 12:123, herein incorporated by reference). Other agronomically important genes encode latex, Floury 2, growth factors, seed storage factors, and transcription factors.

The methods disclosed herein can be used to modify herbicide resistance traits including genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene); glyphosate (e.g., the EPSPS gene and the GAT gene; see, for example, U.S. Publication No. 20040082770 and WO 03/092360); or other such genes known in the art. The bar gene encodes resistance to the herbicide basta, the nptII gene encodes resistance to the antibiotics kanamycin and geneticin, and the ALS-gene mutants encode resistance to the herbicide chlorsulfuron. Additional herbicide resistance traits are described for example in U.S. Patent Application 2016/0208243, herein incorporated by reference.

Sterility genes can also be modified and provide an alternative to physical detasseling. Examples of genes used in such ways include male tissue-preferred genes and genes with male sterility phenotypes such as QM, described in U.S. Pat. No. 5,583,210. Other genes include kinases and those encoding compounds toxic to either male or female gametophytic development. Additional sterility traits are described for example in U.S. Patent Application 2016/0208243, herein incorporated by reference.

The quality of grain can be altered by modifying genes encoding traits such as levels and types of oils, saturated and unsaturated, quality and quantity of essential amino acids, and levels of cellulose. In corn, modified hordothionin proteins are described in U.S. Pat. Nos. 5,703,049, 5,885,801, 5,885,802, and 5,990,389.

Commercial traits can also be altered by modifying a gene or that could increase for example, starch for ethanol production, or provide expression of proteins. Another important commercial use of modified plants is the production of polymers and bioplastics such as described in U.S. Pat. No. 5,602,321. Genes such as β-Ketothiolase, PHBase (polyhydroxyburyrate synthase), and acetoacetyl-CoA reductase (see Schubert et al. (1988) *J. Bacteriol.* 170:5837-5847) facilitate expression of polyhyroxyalkanoates (PHAs).

Exogenous products include plant enzymes and products as well as those from other sources including prokaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

The methods disclosed herein can also be used for insertion of heterologous genes and/or modification of native plant gene expression to achieve desirable plant traits. Such traits include, for example, disease resistance, herbicide tolerance, drought tolerance, salt tolerance, insect resistance, resistance against parasitic weeds, improved plant nutritional value, improved forage digestibility, increased grain yield, cytoplasmic male sterility, altered fruit ripening, increased storage life of plants or plant parts, reduced allergen production, and increased or decreased lignin content. Genes capable of conferring these desirable traits are disclosed in U.S. Patent Application 2016/0208243, herein incorporated by reference.

(a) Cpf1 or Csm1 Polypeptide

The methods disclosed herein comprise introducing into a plant cell, plant organelle, or plant embryo at least one Cpf1 or Csm1 polypeptide or a nucleic acid encoding at least one Cpf1 or Csm1 polypeptide, as described herein. In some embodiments, the Cpf1 or Csm1 polypeptide can be introduced into the plant cell, organelle, or plant embryo as an isolated protein. In such embodiments, the Cpf1 or Csm1 polypeptide can further comprise at least one cell-penetrating domain, which facilitates cellular uptake of the protein. In some embodiments, the Cpf1 or Csm1 polypeptide can be introduced into the plant cell, organelle, or plant embryo as a ribonucleoprotein in complex with a guide RNA. In other embodiments, the Cpf1 or Csm1 polypeptide can be introduced into the plant cell, organelle, or plant embryo as an mRNA molecule. In still other embodiments, the Cpf1 or Csm1 polypeptide can be introduced into the plant cell, organelle, or plant embryo as a DNA molecule. In general, DNA sequences encoding the Cpf1 or Csm1 polypeptide or fusion protein described herein are operably linked to a promoter sequence that will function in the plant cell, organelle, or plant embryo of interest. The DNA sequence can be linear, or the DNA sequence can be part of a vector. In still other embodiments, the Cpf1 or Csm1 polypeptide or fusion protein can be introduced into the plant cell, organelle, or embryo as an RNA-protein complex comprising the guide RNA or a fusion protein and the guide RNA.

In certain embodiments, mRNA encoding the Cpf1 or Csm1 polypeptide may be targeted to an organelle (e.g., plastid or mitochondria). In certain embodiments, mRNA encoding one or more guide RNAs may be targeted to an organelle (e.g., plastid or mitochondria). In certain embodiments, mRNA encoding the Cpf1 or Csm1 polypeptide and one or more guide RNAs may be targeted to an organelle (e.g., plastid or mitochondria). Methods for targeting mRNA to organelles are known in the art (see, e.g., U.S. Patent Application 2011/0296551; U.S. Patent Application 2011/0321187; Gomez and Pallas (2010) PLoS One 5:e12269), and are incorporated herein by reference.

In certain embodiments, DNA encoding the Cpf1 or Csm1 polypeptide can further comprise a sequence encoding a guide RNA. In general, each of the sequences encoding the Cpf1 or Csm1 polypeptide and the guide RNA is operably linked to one or more appropriate promoter control sequences that allow expression of the Cpf1 or Csm1 polypeptide and the guide RNA, respectively, in the plant cell, organelle, or plant embryo. The DNA sequence encoding the Cpf1 or Csm1 polypeptide and the guide RNA can further comprise additional expression control, regulatory, and/or processing sequence(s). The DNA sequence encoding the Cpf1 or Csm1 polypeptide and the guide RNA can be linear or can be part of a vector.

(b) Guide RNA

Methods described herein further can also comprise introducing into a plant cell, organelle, or plant embryo at least one guide RNA or DNA encoding at least one guide RNA. A guide RNA interacts with the Cpf1 or Csm1 polypeptide to direct the Cpf1 or Csm1 polypeptide to a specific target site, at which site the 5' end of the guide RNA base pairs with a specific protospacer sequence in the plant nucleotide sequence. Guide RNAs can comprise three regions: a first region that is complementary to the target site in the targeted chromosomal sequence, a second region that forms a stem loop structure, and a third region that remains essentially single-stranded. The first region of each guide RNA is different such that each guide RNA guides a Cpf1 or Csm1 polypeptide to a specific target site. The second and third regions of each guide RNA can be the same in all guide RNAs.

One region of the guide RNA is complementary to a sequence (i.e., protospacer sequence) at the target site in the plant genome including the nuclear chromosomal sequence as well as plastid or mitochondrial sequences such that the first region of the guide RNA can base pair with the target site. In various embodiments, the first region of the guide RNA can comprise from about 8 nucleotides to more than about 30 nucleotides. For example, the region of base pairing between the first region of the guide RNA and the target site in the nucleotide sequence can be about 8, about 9, about 10, about 11, about 12, about 13, about 14, about 15, about 16, about 17, about 18, about 19, about 20, about 22, about 23, about 24, about 25, about 27, about 30 or more than 30 nucleotides in length. In an exemplary embodiment, the first region of the guide RNA is about 23, 24, or 25 nucleotides in length. The guide RNA also can comprise a second region that forms a secondary structure. In some embodiments, the secondary structure comprises a stem or hairpin. The length of the stem can vary. For example, the stem can range from about 6, to about 10, to about 15, to about 20, to about 25 base pairs in length. The stem can comprise one or more bulges of 1 to about 10 nucleotides.

Thus, the overall length of the second region can range from about 16 to about 25 nucleotides in length. In certain embodiments, the loop is about 5 nucleotides in length and the stem comprises about 10 base pairs.

The guide RNA can also comprise a third region that remains essentially single-stranded. Thus, the third region has no complementarity to any nucleotide sequence in the cell of interest and has no complementarity to the rest of the guide RNA. The length of the third region can vary. In general, the third region is more than about 4 nucleotides in length. For example, the length of the third region can range from about 5 to about 60 nucleotides in length. The combined length of the second and third regions (also called the universal or scaffold region) of the guide RNA can range from about 30 to about 120 nucleotides in length. In one aspect, the combined length of the second and third regions of the guide RNA range from about 40 to about 45 nucleotides in length.

In some embodiments, the guide RNA comprises a single molecule comprising all three regions. In other embodiments, the guide RNA can comprise two separate molecules. The first RNA molecule can comprise the first region of the guide RNA and one half of the "stem" of the second region of the guide RNA. The second RNA molecule can comprise the other half of the "stem" of the second region of the guide RNA and the third region of the guide RNA. Thus, in this embodiment, the first and second RNA molecules each contain a sequence of nucleotides that are complementary to one another. For example, in one embodiment, the first and second RNA molecules each comprise a sequence (of about 6 to about 25 nucleotides) that base pairs to the other sequence to form a functional guide RNA. In specific embodiments, the guide RNA is a single molecule (i.e., crRNA) that interacts with the target site in the chromosome and the Cpf1 polypeptide without the need for a second guide RNA (i.e., a tracrRNA).

In certain embodiments, the guide RNA can be introduced into the plant cell, organelle, or plant embryo as an RNA molecule. The RNA molecule can be transcribed in vitro. Alternatively, the RNA molecule can be chemically synthesized. In other embodiments, the guide RNA can be introduced into the plant cell, organelle, or embryo as a DNA molecule. In such cases, the DNA encoding the guide RNA can be operably linked to promoter control sequence for expression of the guide RNA in the plant cell, organelle, or plant embryo of interest. For example, the RNA coding sequence can be operably linked to a promoter sequence that is recognized by RNA polymerase III (Pol III). In exemplary embodiments, the RNA coding sequence is linked to a plant specific promoter.

The DNA molecule encoding the guide RNA can be linear or circular. In some embodiments, the DNA sequence encoding the guide RNA can be part of a vector. Suitable vectors include plasmid vectors, phagemids, cosmids, artificial/mini-chromosomes, transposons, and viral vectors. In an exemplary embodiment, the DNA encoding the Cpf1 or Csm1 polypeptide is present in a plasmid vector. Non-limiting examples of suitable plasmid vectors include pUC, pBR322, pET, pBluescript, pCAMBIA, and variants thereof. The vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like.

In embodiments in which both the Cpf1 or Csm1 polypeptide and the guide RNA are introduced into the plant cell, organelle, or embryo as DNA molecules, each can be part of a separate molecule (e.g., one vector containing Cpf1 or Csm1 polypeptide or fusion protein coding sequence and a second vector containing guide RNA coding sequence) or both can be part of the same molecule (e.g., one vector containing coding (and regulatory) sequence for both the Cpf1 or Csm1 polypeptide or fusion protein and the guide RNA).

(c) Target Site

A Cpf1 or Csm1 polypeptide in conjunction with a guide RNA is directed to a target site in a plant, including the chromosomal sequence of a plant, plant cell, plant organelle (e.g., plastid or mitochondria) or plant embryo, wherein the Cpf1 or Csm1 polypeptide introduces a double-stranded break in the chromosomal sequence. The target site has no sequence limitation except that the sequence is immediately preceded (upstream) by a consensus sequence. This consensus sequence is also known as a protospacer adjacent motif (PAM). Examples of PAM sequences include, but are not limited to, TTN, CTN, TCN, CCN, TTTN, TCTN, TTCN, CTTN, ATTN, TCCN, TTGN, GTTN, CCCN, CCTN, TTAN, TCGN, CTCN, ACTN, GCTN, TCAN, GCCN, and CCGN (wherein N is defined as any nucleotide). It is well-known in the art that PAM sequence specificity for a given nuclease enzyme is affected by enzyme concentration (Karvelis et al. (2015) *Genome Biol* 16:253). Thus, modulating the concentrations of Cpf1 or Csm1 protein delivered to the cell or in vitro system of interest represents a way to alter the PAM site or sites associated with that Cpf1 or Csm1 enzyme. Modulating Cpf1 or Csm1 protein concentration in the system of interest may be achieved, for instance, by altering the promoter used to express the Cpf1-encoding or Csm1-encoding gene, by altering the concentration of ribonucleoprotein delivered to the cell or in vitro system, or by adding or removing introns that may play a role in modulating gene expression levels. As detailed herein, the first region of the guide RNA is complementary to the protospacer of the target sequence. Typically, the first region of the guide RNA is about 19 to 21 nucleotides in length.

The target site can be in the coding region of a gene, in an intron of a gene, in a control region of a gene, in a non-coding region between genes, etc. The gene can be a protein coding gene or an RNA coding gene. The gene can be any gene of interest as described herein.

(d) Donor Polynucleotide

In some embodiments, the methods disclosed herein further comprise introducing at least one donor polynucleotide into a plant cell, organelle, or plant embryo. A donor polynucleotide comprises at least one donor sequence. In some aspects, a donor sequence of the donor polynucleotide corresponds to an endogenous or native plant genomic sequence found in the cell nucleus or in an organelle of interest (e.g., plastid or mitochondria). For example, the donor sequence can be essentially identical to a portion of the chromosomal sequence at or near the targeted site, but which comprises at least one nucleotide change. Thus, the donor sequence can comprise a modified version of the wild type sequence at the targeted site such that, upon integration or exchange with the native sequence, the sequence at the targeted location comprises at least one nucleotide change. For example, the change can be an insertion of one or more nucleotides, a deletion of one or more nucleotides, a substitution of one or more nucleotides, or combinations thereof. As a consequence of the integration of the modified sequence, the plant, plant cell, or plant embryo can produce a modified gene product from the targeted chromosomal sequence.

The donor sequence of the donor polynucleotide can alternatively correspond to an exogenous sequence. As used herein, an "exogenous" sequence refers to a sequence that is not native to the plant cell, organelle, or embryo, or a sequence whose native location in the genome of the cell, organelle, or embryo is in a different location. For example, the exogenous sequence can comprise a protein coding sequence, which can be operably linked to an exogenous promoter control sequence such that, upon integration into the genome, the plant cell or organelle is able to express the protein coded by the integrated sequence. For example, the donor sequence can be any gene of interest, such as those encoding agronomically important traits as described elsewhere herein. Alternatively, the exogenous sequence can be integrated into the nuclear, plastid, and/or mitochondrial chromosomal sequence such that its expression is regulated by an endogenous promoter control sequence. In other iterations, the exogenous sequence can be a transcriptional control sequence, another expression control sequence, or an RNA coding sequence. Integration of an exogenous sequence into a chromosomal sequence is termed a "knock in." The donor sequence can vary in length from several nucleotides to hundreds of nucleotides to hundreds of thousands of nucleotides.

In some embodiments, the donor sequence in the donor polynucleotide is flanked by an upstream sequence and a downstream sequence, which have substantial sequence identity to sequences located upstream and downstream, respectively, of the targeted site in the plant nuclear, plastid, and/or mitochondrial genomic sequence. Because of these sequence similarities, the upstream and downstream sequences of the donor polynucleotide permit homologous recombination between the donor polynucleotide and the targeted sequence such that the donor sequence can be integrated into (or exchanged with) the targeted plant sequence.

The upstream sequence, as used herein, refers to a nucleic acid sequence that shares substantial sequence identity with a chromosomal sequence upstream of the targeted site. Similarly, the downstream sequence refers to a nucleic acid sequence that shares substantial sequence identity with a chromosomal sequence downstream of the targeted site. As used herein, the phrase "substantial sequence identity" refers to sequences having at least about 75% sequence identity. Thus, the upstream and downstream sequences in the donor polynucleotide can have about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with sequence upstream or downstream to the targeted site. In an exemplary embodiment, the upstream and downstream sequences in the donor polynucleotide can have about 95% or 100% sequence identity with nucleotide sequences upstream or downstream to the targeted site. In one embodiment, the upstream sequence shares substantial sequence identity with a nucleotide sequence located immediately upstream of the targeted site (i.e., adjacent to the targeted site). In other embodiments, the upstream sequence shares substantial sequence identity with a nucleotide sequence that is located within about one hundred (100) nucleotides upstream from the targeted site. Thus, for example, the upstream sequence can share substantial sequence identity with a nucleotide sequence that is located about 1 to about 20, about 21 to about 40, about 41 to about 60, about 61 to about 80, or about 81 to about 100 nucleotides upstream from the targeted site. In one embodiment, the downstream sequence shares substantial sequence identity with a nucleotide sequence located immediately downstream of the targeted site (i.e., adjacent to the targeted site). In other embodiments, the downstream sequence shares substantial sequence identity with a nucleotide sequence that is located within about one hundred (100) nucleotides downstream from the targeted site. Thus, for example, the downstream sequence can share substantial sequence identity with a nucleotide sequence that is located about 1 to about 20, about 21 to about 40, about 41 to about 60, about 61 to about 80, or about 81 to about 100 nucleotides downstream from the targeted site.

Each upstream or downstream sequence can range in length from about 20 nucleotides to about 5000 nucleotides. In some embodiments, upstream and downstream sequences can comprise about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2800, 3000, 3200, 3400, 3600, 3800, 4000, 4200, 4400, 4600, 4800, or 5000 nucleotides. In exemplary embodiments, upstream and downstream sequences can range in length from about 50 to about 1500 nucleotides.

Donor polynucleotides comprising the upstream and downstream sequences with sequence similarity to the targeted nucleotide sequence can be linear or circular. In embodiments in which the donor polynucleotide is circular, it can be part of a vector. For example, the vector can be a plasmid vector.

In certain embodiments, the donor polynucleotide can additionally comprise at least one targeted cleavage site that is recognized by the Cpf1 or Csm1 polypeptide. The targeted cleavage site added to the donor polynucleotide can be placed upstream or downstream or both upstream and downstream of the donor sequence. For example, the donor sequence can be flanked by targeted cleavage sites such that, upon cleavage by the Cpf1 or Csm1 polypeptide, the donor sequence is flanked by overhangs that are compatible with those in the nucleotide sequence generated upon cleavage by the Cpf1 or Csm1 polypeptide. Accordingly, the donor sequence can be ligated with the cleaved nucleotide sequence during repair of the double stranded break by a non-homologous repair process. Generally, donor polynucleotides comprising the targeted cleavage site(s) will be circular (e.g., can be part of a plasmid vector).

The donor polynucleotide can be a linear molecule comprising a short donor sequence with optional short overhangs that are compatible with the overhangs generated by the Cpf1 or Csm1 polypeptide. In such embodiments, the donor sequence can be ligated directly with the cleaved chromosomal sequence during repair of the double-stranded break. In some instances, the donor sequence can be less than about 1,000, less than about 500, less than about 250, or less than about 100 nucleotides. In certain cases, the donor polynucleotide can be a linear molecule comprising a short donor sequence with blunt ends. In other iterations, the donor polynucleotide can be a linear molecule comprising a short donor sequence with 5' and/or 3' overhangs. The overhangs can comprise 1, 2, 3, 4, or 5 nucleotides.

In some embodiments, the donor polynucleotide will be DNA. The DNA may be single-stranded or double-stranded and/or linear or circular. The donor polynucleotide may be a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer. In certain embodiments, the donor polynucleotide comprising the donor sequence can be part of a plasmid vector. In any of these situations, the donor polynucleotide comprising the donor sequence can further comprise at least one additional sequence.

(e) Introducing into the Plant Cell

The Cpf1 or Csm1 polypeptide (or encoding nucleic acid), the guide RNA(s) (or encoding DNA), and the optional donor polynucleotide(s) can be introduced into a plant cell, organelle, or plant embryo by a variety of means, including transformation. Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. No. 5,563,055 and U.S. Pat. No. 5,981,840), direct gene transfer (Paszkowski et al. (1984) *EMBO J.* 3:2717-2722), and ballistic particle acceleration (see, for example, U.S. Pat. No. 4,945,050; U.S. Pat. No. 5,879,918; U.S. Pat. Nos. 5,886,244; and, 5,932,782; Tomes et al. (1995) in Plant Cell, Tissue, and Organ Culture: Fundamental Methods, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in The Experimental Manipulation of Ovule Tissues, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference. Site-specific genome editing of plant cells by biolistic introduction of a ribonucleoprotein comprising a nuclease and suitable guide RNA has been demonstrated (Svitashev et al (2016) *Nat Commun* doi: 10.1038/ncomms13274); these methods are herein incorporated by reference. "Stable transformation" is intended to mean that the nucleotide construct introduced into a plant integrates into the genome of the plant and is capable of being inherited by the progeny thereof. The nucleotide construct may be integrated into the nuclear, plastid, or mitochondrial genome of the plant. Methods for plastid transformation are known in the art (see, e.g., Chloroplast Biotechnology: Methods and Protocols (2014) Pal Maliga, ed. and U.S. Patent Application 2011/0321187), and methods for plant mitochondrial transformation have been described in the art (see, e.g., U.S. Patent Application 2011/0296551), herein incorporated by reference.

The cells that have been transformed may be grown into plants (i.e., cultured) in accordance with conventional ways. See, for example, McCormick et al. (1986) *Plant Cell Reports* 5:81-84. In this manner, the present invention provides transformed seed (also referred to as "transgenic seed") having a nucleic acid modification stably incorporated into their genome.

"Introduced" in the context of inserting a nucleic acid fragment (e.g., a recombinant DNA construct) into a cell, means "transfection" or "transformation" or "transduction" and includes reference to the incorporation of a nucleic acid fragment into a plant cell where the nucleic acid fragment may be incorporated into the genome of the cell (e.g., nuclear chromosome, plasmid, plastid chromosome or mitochondrial chromosome), converted into an autonomous replicon, or transiently expressed (e.g., transfected mRNA).

The present invention may be used for transformation of any plant species, including, but not limited to, monocots and dicots (i.e., monocotyledonous and dicotyledonous, respectively). Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oil palm (*Elaeis guineensis*), poplar (*Populus* spp.), eucalyptus (*Eucalyptus* spp.), oats (*Avena sativa*), barley (*Hordeum vulgare*), vegetables, ornamentals, and conifers.

The Cpf1 or Csm1 polypeptides (or encoding nucleic acid), the guide RNA(s) (or DNAs encoding the guide RNA), and the optional donor polynucleotide(s) can be introduced into the plant cell, organelle, or plant embryo simultaneously or sequentially. The ratio of the Cpf1 polypeptides (or encoding nucleic acid) to the guide RNA(s) (or encoding DNA) generally will be about stoichiometric such that the two components can form an RNA-protein complex with the target DNA. In one embodiment, DNA encoding a Cpf1 or Csm1 polypeptide and DNA encoding a guide RNA are delivered together within the plasmid vector.

The compositions and methods disclosed herein can be used to alter expression of genes of interest in a plant, such as genes involved in photosynthesis. Therefore, the expression of a gene encoding a protein involved in photosynthesis may be modulated as compared to a control plant. A "subject plant or plant cell" is one in which genetic alteration, such as a mutation, has been effected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell. Thus, the expression levels are higher or lower than those in the control plant depending on the methods of the invention.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

While the invention is described in terms of transformed plants, it is recognized that transformed organisms of the invention also include plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

(f) Method for Using a Fusion Protein to Modify a Plant Sequence or Regulate Expression of a Plant Sequence The methods disclosed herein further encompass modification of a nucleotide sequence or regulating expression of a nucleotide sequence in a plant cell, plant organelle, or plant embryo. The methods can comprise introducing into the plant cell or plant embryo at least one fusion protein or nucleic acid encoding at least one fusion protein, wherein the fusion protein comprises a Cpf1 or Csm1 polypeptide or a fragment or variant thereof and an effector domain, and (b) at least one guide RNA or DNA encoding the guide RNA, wherein the guide RNA guides the Cpf1 or Csm1 polypeptide of the fusion protein to a target site in the chromosomal sequence and the effector domain of the fusion protein modifies the chromosomal sequence or regulates expression of the chromosomal sequence.

Fusion proteins comprising a Cpf1 or Csm1 polypeptide or a fragment or variant thereof and an effector domain are described herein. In general, the fusion proteins disclosed herein can further comprise at least one nuclear localization signal, plastid signal peptide, mitochondrial signal peptide, or signal peptide capable of trafficking proteins to multiple subcellular locations. Nucleic acids encoding fusion proteins are described herein. In some embodiments, the fusion protein can be introduced into the cell or embryo as an isolated protein (which can further comprise a cell-penetrating domain). Furthermore, the isolated fusion protein can be part of a protein-RNA complex comprising the guide RNA. In other embodiments, the fusion protein can be introduced into the cell or embryo as a RNA molecule (which can be capped and/or polyadenylated). In still other embodiments, the fusion protein can be introduced into the cell or embryo as a DNA molecule. For example, the fusion protein and the guide RNA can be introduced into the cell or embryo as discrete DNA molecules or as part of the same DNA molecule. Such DNA molecules can be plasmid vectors.

In some embodiments, the method further comprises introducing into the cell, organelle, or embryo at least one donor polynucleotide as described elsewhere herein. Means for introducing molecules into plant cells, organelles, or plant embryos, as well as means for culturing cells (including cells comprising organelles) or embryos are described herein.

In certain embodiments in which the effector domain of the fusion protein is a cleavage domain, the method can comprise introducing into the plant cell, organelle, or plant embryo one fusion protein (or nucleic acid encoding one fusion protein) and two guide RNAs (or DNA encoding two guide RNAs). The two guide RNAs direct the fusion protein to two different target sites in the chromosomal sequence, wherein the fusion protein dimerizes (e.g., forms a homodimer) such that the two cleavage domains can introduce a double stranded break into the chromosomal sequence. In embodiments in which the optional donor polynucleotide is not present, the double-stranded break in the chromosomal sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted chromosomal sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the chromosomal sequence at the targeted site during repair of the double-stranded break. For example, in embodiments in which the donor sequence is flanked by upstream and downstream sequences having substantial sequence identity with upstream and downstream sequences, respectively, of the targeted site in the chromosomal sequence, the donor sequence can be exchanged with or integrated into the chromosomal sequence at the targeted site during repair mediated by homology-directed repair process. Alternatively, in embodiments in which the donor sequence is flanked by compatible overhangs (or the compatible overhangs are generated in situ by the Cpf1 or Csm1 polypeptide) the donor sequence can be ligated directly with the cleaved chromosomal sequence by a non-homologous repair process during repair of the double-stranded break. Exchange or integration of the donor sequence into the chromosomal sequence modifies the targeted chromosomal sequence or introduces an exogenous sequence into the chromosomal sequence of the plant cell, organelle, or embryo.

In other embodiments in which the effector domain of the fusion protein is a cleavage domain, the method can comprise introducing into the plant cell, organelle, or plant embryo two different fusion proteins (or nucleic acid encoding two different fusion proteins) and two guide RNAs (or DNA encoding two guide RNAs). The fusion proteins can differ as detailed elsewhere herein. Each guide RNA directs a fusion protein to a specific target site in the chromosomal sequence, wherein the fusion proteins can dimerize (e.g., form a heterodimer) such that the two cleavage domains can introduce a double stranded break into the chromosomal sequence. In embodiments in which the optional donor polynucleotide is not present, the resultant double-stranded breaks can be repaired by a non-homologous repair process such that deletions of at least one nucleotide, insertions of at least one nucleotide, substitutions of at least one nucleotide, or combinations thereof can occur during the repair of the break. In embodiments in which the optional donor polynucleotide is present, the donor sequence in the donor polynucleotide can be exchanged with or integrated into the chromosomal sequence during repair of the double-stranded break by either a homology-based repair process (e.g., in embodiments in which the donor sequence is flanked by upstream and downstream sequences having substantial sequence identity with upstream and downstream sequences, respectively, of the targeted sites in the chromosomal sequence) or a non-homologous repair process (e.g., in embodiments in which the donor sequence is flanked by compatible overhangs).

In certain embodiments in which the effector domain of the fusion protein is a transcriptional activation domain or a transcriptional repressor domain, the method can comprise introducing into the plant cell, organelle, or plant embryo one fusion protein (or nucleic acid encoding one fusion protein) and one guide RNA (or DNA encoding one guide RNA). The guide RNA directs the fusion protein to a specific chromosomal sequence, wherein the transcriptional activation domain or a transcriptional repressor domain activates or represses expression, respectively, of a gene or genes located near the targeted chromosomal sequence. That is, transcription may be affected for genes in close proximity to the targeted chromosomal sequence or may be affected for genes located at further distance from the targeted chromosomal sequence. It is well-known in the art that gene transcription can be regulated by distantly located sequences that may be located thousands of bases away from the transcription start site or even on a separate chromosome (Harmston and Lenhard (2013) *Nucleic Acids Res* 41:7185-7199).

In alternate embodiments in which the effector domain of the fusion protein is an epigenetic modification domain, the method can comprise introducing into the plant cell, organelle, or plant embryo one fusion protein (or nucleic acid encoding one fusion protein) and one guide RNA (or DNA encoding one guide RNA). The guide RNA directs the fusion protein to a specific chromosomal sequence, wherein the epigenetic modification domain modifies the structure of the targeted the chromosomal sequence. Epigenetic modifications include acetylation, methylation of histone proteins and/or nucleotide methylation. In some instances, structural modification of the chromosomal sequence leads to changes in expression of the chromosomal sequence.

V. Plants and Plant Cells Comprising a Genetic Modification

Provided herein are plants, plant cells, plant organelles, and plant embryos comprising at least one nucleotide sequence that has been modified using a Cpf1 or Csm1 polypeptide-mediated or fusion protein-mediated process as described herein. Also provided are plant cells, organelles, and plant embryos comprising at least one DNA or RNA molecule encoding Cpf1 or Csm1 polypeptide or fusion protein targeted to a chromosomal sequence of interest or a fusion protein, at least one guide RNA, and optionally one or more donor polynucleotide(s). The genetically modified plants disclosed herein can be heterozygous for the modified nucleotide sequence or homozygous for the modified nucleotide sequence. Plant cells comprising one or more genetic modifications in organellar DNA may be heteroplasmic or homoplasmic.

The modified chromosomal sequence of the plant, plant organelle, or plant cell may be modified such that it is inactivated, has up-regulated or down-regulated expression, or produces an altered protein product, or comprises an integrated sequence. The modified chromosomal sequence may be inactivated such that the sequence is not transcribed and/or a functional protein product is not produced. Thus, a genetically modified plant comprising an inactivated chromosomal sequence may be termed a "knock out" or a "conditional knock out." The inactivated chromosomal sequence can include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). As a consequence of the mutation, the targeted chromosomal sequence is inactivated and a functional protein is not produced. The inactivated chromosomal sequence comprises no exogenously introduced sequence. Also included herein are genetically modified plants in which two, three, four, five, six, seven, eight, nine, or ten or more chromosomal sequences are inactivated.

The modified chromosomal sequence can also be altered such that it codes for a variant protein product. For example, a genetically modified plant comprising a modified chromosomal sequence can comprise a targeted point mutation(s) or other modification such that an altered protein product is produced. In one embodiment, the chromosomal sequence can be modified such that at least one nucleotide is changed and the expressed protein comprises one changed amino acid residue (missense mutation). In another embodiment, the chromosomal sequence can be modified to comprise more than one missense mutation such that more than one amino acid is changed. Additionally, the chromosomal sequence can be modified to have a three nucleotide deletion or insertion such that the expressed protein comprises a single amino acid deletion or insertion. The altered or variant protein can have altered properties or activities compared to the wild type protein, such as altered substrate specificity, altered enzyme activity, altered kinetic rates, etc.

In some embodiments, the genetically modified plant can comprise at least one chromosomally integrated nucleotide sequence. A genetically modified plant comprising an integrated sequence may be termed a "knock in" or a "conditional knock in." The nucleotide sequence that is integrated sequence can, for example, encode an orthologous protein, an endogenous protein, or combinations of both. In one embodiment, a sequence encoding an orthologous protein or an endogenous protein can be integrated into a nuclear or organellar chromosomal sequence encoding a protein such that the chromosomal sequence is inactivated, but the exogenous sequence is expressed. In such a case, the sequence encoding the orthologous protein or endogenous protein may be operably linked to a promoter control sequence. Alternatively, a sequence encoding an orthologous protein or an endogenous protein may be integrated into a nuclear or organellar chromosomal sequence without affecting expression of a chromosomal sequence. For example, a sequence encoding a protein can be integrated into a "safe harbor" locus. The present disclosure also encompasses genetically modified plants in which two, three, four, five, six, seven, eight, nine, or ten or more sequences, including sequences encoding protein(s), are integrated into the genome. Any gene of interest as disclosed herein can be introduced integrated into the chromosomal sequence of the plant nucleus or organelle. In particular embodiments, genes that increase plant growth or yield are integrated into the chromosome.

The chromosomally integrated sequence encoding a protein can encode the wild type form of a protein of interest or can encode a protein comprising at least one modification such that an altered version of the protein is produced. For example, a chromosomally integrated sequence encoding a protein related to a disease or disorder can comprise at least one modification such that the altered version of the protein produced causes or potentiates the associated disorder. Alternatively, the chromosomally integrated sequence encoding a protein related to a disease or disorder can comprise at least one modification such that the altered version of the protein protects the plant against the development of the associated disease or disorder.

In certain embodiments, the genetically modified plant can comprise at least one modified chromosomal sequence encoding a protein such that the expression pattern of the protein is altered. For example, regulatory regions controlling the expression of the protein, such as a promoter or a transcription factor binding site, can be altered such that the protein is over-expressed, or the tissue-specific or temporal expression of the protein is altered, or a combination thereof. Alternatively, the expression pattern of the protein can be altered using a conditional knockout system. A non-limiting example of a conditional knockout system includes a Cre-lox recombination system. A Cre-lox recombination system comprises a Cre recombinase enzyme, a site-specific DNA recombinase that can catalyze the recombination of a nucleic acid sequence between specific sites (lox sites) in a nucleic acid molecule. Methods of using this system to produce temporal and tissue specific expression are known in the art.

VI. Methods for Modifying a Nucleotide Sequence in a Non-Plant Eukaryotic Genome and Non-Plant Eukaryotic Cells Comprising a Genetic Modification Methods are provided herein for modifying a nucleotide sequence of a non-plant eukaryotic cell, or non-plant eukaryotic organelle. The methods comprise introducing into a target cell or organelle a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide and also introducing to the target cell or organelle a Cpf1 or Csm1 polypeptide, or a polynucleotide encoding a Cpf1 or Csm1 polypeptide, wherein the Cpf1 or Csm1 polypeptide comprises: (a) an RNA-binding portion that interacts with the DNA-targeting RNA; and (b) an activity portion that exhibits site-directed enzymatic activity. The target cell or organelle can then be cultured under conditions in which the chimeric nuclease polypeptide is expressed and cleaves the nucleotide sequence. It is noted that the system described herein does not require the addition of exogenous $Mg^{2+}$ or any other ions. Finally, a non-plant eukaryotic cell or organelle comprising the modified nucleotide sequence can be selected.

In some embodiments, the method can comprise introducing one Cpf1 or Csm1 polypeptide (or encoding nucleic acid) and one guide RNA (or encoding DNA) into a non-plant eukaryotic cell or organelle wherein the Cpf1 or Csm1 polypeptide introduces one double-stranded break in the target nucleotide sequence of the nuclear or organellar chromosomal DNA. In some embodiments, the method can comprise introducing one Cpf1 or Csm1 polypeptide (or encoding nucleic acid) and at least one guide RNA (or encoding DNA) into a non-plant eukaryotic cell or organelle wherein the Cpf1 or Csm1 polypeptide introduces more than one double-stranded break (i.e., two, three, or more than three double-stranded breaks) in the target nucleotide sequence of the nuclear or organellar chromosomal DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence of the non-plant eukaryotic cell or organelle, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cpf1 or Csm1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence or introduces an exogenous sequence into the targeted nucleotide sequence of the non-plant eukaryotic cell or organelle.

In some embodiments, the double-stranded breaks caused by the action of the Cpf1 or Csm1 nuclease or nucleases are repaired in such a way that DNA is deleted from the chromosome of the non-plant eukaryotic cell or organelle. In some embodiments one base, a few bases (i.e., 2, 3, 4, 5, 6, 7, 8, 9, or 10 bases), or a large section of DNA (i.e., more than 10, more than 50, more than 100, or more than 500 bases) is deleted from the chromosome of the non-plant eukaryotic cell or organelle.

In some embodiments, the expression of non-plant eukaryotic genes may be modulated as a result of the double-stranded breaks caused by the Cpf1 or Csm1 nuclease or nucleases. In some embodiments, the expression of non-plant eukaryotic genes may be modulated by variant Cpf1 or Csm1 enzymes comprising a mutation that renders the Cpf1 or Csm1 nuclease incapable of producing a double-stranded break. In some preferred embodiments, the variant Cpf1 or Csm1 nuclease comprising a mutation that renders the Cpf1 or Csm1 nuclease incapable of producing a double-stranded break may be fused to a transcriptional activation or transcriptional repression domain.

In some embodiments, a eukaryotic cell comprising mutations in its nuclear and/or organellar chromosomal DNA caused by the action of a Cpf1 or Csm1 nuclease or nucleases is cultured to produce a eukaryotic organism. In some embodiments, a eukaryotic cell in which gene expression is modulated as a result of one or more Cpf1 or Csm1 nucleases, or one or more variant Cpf1 or Csm1 nucleases, is cultured to produce a eukaryotic organism. Methods for culturing non-plant eukaryotic cells to produce eukaryotic organisms are known in the art, for instance in U.S. Patent Applications 2016/0208243 and 2016/0138008, herein incorporated by reference.

The present invention may be used for transformation of any eukaryotic species, including, but not limited to animals (including but not limited to mammals, insects, fish, birds, and reptiles), fungi, amoeba, and yeast.

Methods for the introduction of nuclease proteins, DNA or RNA molecules encoding nuclease proteins, guide RNAs or DNA molecules encoding guide RNAs, and optional donor sequence DNA molecules into non-plant eukaryotic cells or organelles are known in the art, for instance in U.S. Patent Application 2016/0208243, herein incorporated by reference. Exemplary genetic modifications to non-plant eukaryotic cells or organelles that may be of particular value for industrial applications are also known in the art, for instance in U.S. Patent Application 2016/0208243, herein incorporated by reference.

VII. Methods for Modifying a Nucleotide Sequence in a Prokaryotic Genome and Prokaryotic Cells Comprising a Genetic Modification Methods are provided herein for modifying a nucleotide sequence of a prokaryotic (e.g., bacterial or archeal) cell. The methods comprise introducing into a target cell a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide and also introducing to the target cell a Cpf1 or Csm1 polypeptide, or a polynucleotide encoding a Cpf1 or Csm1 polypeptide, wherein the Cpf1 or Csm1 polypeptide comprises: (a) an RNA-binding portion that interacts with the DNA-targeting RNA; and (b) an activity portion that exhibits site-directed enzymatic activity. The target cell can then be cultured under conditions in which the Cpf1 or Csm1 polypeptide is expressed and cleaves the nucleotide sequence. It is noted that the system described herein does not require the addition of exogenous $Mg^{2+}$ or any other ions. Finally, prokaryotic cells comprising the modified nucleotide sequence can be selected. It is further noted that he prokaryotic cells comprising the modified nucleotide sequence or sequences are not the natural host cells of the polynucleotides encoding the Cpf1 or Csm1 polypeptide of interest, and that a non-naturally occurring guide RNA is used to effect the desired changes in the prokaryotic nucleotide sequence or sequences. It is further noted that the targeted DNA may be present as part of the prokaryotic chromosome(s) or may be present on one or more plasmids or other non-chromosomal DNA molecules in the prokaryotic cell.

In some embodiments, the method can comprise introducing one Cpf1 or Csm1 polypeptide (or encoding nucleic acid) and one guide RNA (or encoding DNA) into a prokaryotic cell wherein the Cpf1 or Csm1 polypeptide introduces one double-stranded break in the target nucleotide sequence of the prokaryotic cellular DNA. In some embodiments, the method can comprise introducing one Cpf1 or Csm1 polypeptide (or encoding nucleic acid) and at least one guide RNA (or encoding DNA) into a prokaryotic cell wherein the Cpf1 or Csm1 polypeptide introduces more than one double-stranded break (i.e., two, three, or more than three double-stranded breaks) in the target nucleotide sequence of the prokaryotic cellular DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence of the prokaryotic cell, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cpf1 or Csm1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence or introduces an exogenous sequence into the targeted nucleotide sequence of the prokaryotic cellular DNA.

In some embodiments, the double-stranded breaks caused by the action of the Cpf1 or Csm1 nuclease or nucleases are repaired in such a way that DNA is deleted from the prokaryotic cellular DNA. In some embodiments one base, a few bases (i.e., 2, 3, 4, 5, 6, 7, 8, 9, or 10 bases), or a large section of DNA (i.e., more than 10, more than 50, more than 100, or more than 500 bases) is deleted from the prokaryotic cellular DNA.

In some embodiments, the expression of prokaryotic genes may be modulated as a result of the double-stranded breaks caused by the Cpf1 or Csm1 nuclease or nucleases. In some embodiments, the expression of prokaryotic genes may be modulated by variant Cpf1 or Csm1 nucleases comprising a mutation that renders the Cpf1 or Csm1 nuclease incapable of producing a double-stranded break. In some preferred embodiments, the variant Cpf1 or Csm1 nuclease comprising a mutation that renders the Cpf1 or Csm1 nuclease incapable of producing a double-stranded break may be fused to a transcriptional activation or transcriptional repression domain.

The present invention may be used for transformation of any prokaryotic species, including, but not limited to, cyanobacteria, *Corynebacterium* sp., *Bifidobacterium* sp., *Mycobacterium* sp., *Streptomyces* sp., *Thermobifida* sp., *Chlamydia* sp., *Prochlorococcus* sp., *Synechococcus* sp., *Thermosynechococcus* sp., *Thermus* sp., *Bacillus* sp., *Clostridium* sp., *Geobacillus* sp., *Lactobacillus* sp., *Listeria* sp., *Staphylococcus* sp., *Streptococcus* sp., *Fusobacterium* sp., *Agrobacterium* sp., *Bradyrhizobium* sp., *Ehrlichia* sp., *Mesorhizobium* sp., *Nitrobacter* sp., *Rickettsia* sp., *Wolbachia* sp., *Zymomonas* sp., *Burkholderia* sp., *Neisseria* sp., *Ralstonia* sp., *Acinetobacter* sp., *Erwinia* sp., *Escherichia* sp., *Haemophilus* sp., *Legionella* sp., *Pasteurella* sp.,

*Pseudomonas* sp., *Psychrobacter* sp., *Salmonella* sp., *Shewanella* sp., *Shigella* sp., *Vibrio* sp., *Xanthomonas* sp., *Xylella* sp., *Yersinia* sp., *Campylobacter* sp., *Desulfovibrio* sp., *Helicobacter* sp., *Geobacter* sp., *Leptospira* sp., *Treponema* sp., *Mycoplasma* sp., and *Thermotoga* sp.

Methods for the introduction of nuclease proteins, DNA or RNA molecules encoding nuclease proteins, guide RNAs or DNA molecules encoding guide RNAs, and optional donor sequence DNA molecules into prokaryotic cells or organelles are known in the art, for instance in U.S. Patent Application 2016/0208243, herein incorporated by reference. Exemplary genetic modifications to prokaryotic cells that may be of particular value for industrial applications are also known in the art, for instance in U.S. Patent Application 2016/0208243, herein incorporated by reference.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

Embodiments of the invention include:

1. A method of modifying a nucleotide sequence at a target site in the genome of a eukaryotic cell comprising:
    introducing into said eukaryotic cell
    (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide; and
    (ii) a Cpf1 or Csm1 polypeptide, or a polynucleotide encoding a Cpf1 or Csm1 polypeptide, wherein the Cpf1 or Csm1 polypeptide comprises: (a) an RNA-binding portion that interacts with the DNA-targeting RNA; and (b) an activity portion that exhibits site-directed enzymatic activity.

2. A method of modifying a nucleotide sequence at a target site in the genome of a prokaryotic cell comprising:
    introducing into said prokaryotic cell
    (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide; and
    (ii) a Cpf1 or Csm1 polypeptide, or a polynucleotide encoding a Cpf1 or Csm1 polypeptide, wherein the Cpf1 or Csm1 polypeptide comprises: (a) an RNA-binding portion that interacts with the DNA-targeting RNA; and (b) an activity portion that exhibits site-directed enzymatic activity,
    wherein said prokaryotic cell is not the native host of a gene encoding said Cpf1 or Csm1 polypeptide.

3. A method of modifying a nucleotide sequence at a target site in the genome of a plant cell comprising:
    introducing into said plant cell
    (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cpf1 or Csm1 polypeptide; and
    (ii) a Cpf1 or Csm1 polypeptide, or a polynucleotide encoding a Cpf1 or Csm1 polypeptide, wherein the Cpf1 or Csm1 polypeptide comprises: (a) an RNA-binding portion that interacts with the DNA-targeting RNA; and (b) an activity portion that exhibits site-directed enzymatic activity.

4. The method of any one of embodiments 1-3, further comprising:
    culturing the plant under conditions in which the Cpf1 or Csm1 polypeptide is expressed and cleaves the nucleotide sequence at the target site to produce a modified nucleotide sequence; and
    selecting a plant comprising said modified nucleotide sequence.

5. The method of any one of embodiments 1-4, wherein cleaving of the nucleotide sequence at the target site comprises a double strand break at or near the sequence to which the DNA-targeting RNA sequence is targeted.

6. The method of embodiment 5, wherein said double strand break is a staggered double strand break.

7. The method of embodiment 6, wherein said staggered double strand break creates a 5' overhang of 3-6 nucleotides.

8. The method of any one of embodiments 1-7, wherein said DNA-targeting RNA is a guide RNA (gRNA).

9. The method of any one of embodiments 1-8, wherein said modified nucleotide sequence comprises insertion of heterologous DNA into the genome of the cell, deletion of a nucleotide sequence from the genome of the cell, or mutation of at least one nucleotide in the genome of the cell.

10. The method of any one of embodiments 1-9, wherein said Cpf1 or Csm1 polypeptide is selected from the group consisting of: SEQ ID NOs: 3, 6, 9, 12, 15, 18, 20, 23, 106-173, and 230-236.

11. The method of any one of embodiments 1-10, wherein said polynucleotide encoding a Cpf1 or Csm1 polypeptide is selected from the group of SEQ ID NOs: 4, 5, 7, 8, 10, 11, 13, 14, 16, 17, 19, 21, 22, 24, 25, and 174-206.

12. The method of any one of embodiments 1-11, wherein said Cpf1 or Csm1 polypeptide has at least 80% identity with one or more polypeptide sequences selected from the group of SEQ ID NOs: 3, 6, 9, 12, 15, 18, 20, 23, 106-173, and 230-236.

13. The method of any one of embodiments 1-12, wherein said polynucleotide encoding a Cpf1 or Csm1 polypeptide has at least 70% identity with one or more nucleic acid sequences selected from the group of SEQ ID NOs: 4, 5, 7, 8, 10, 11, 13, 14, 16, 17, 19, 21, 22, 24, 25, and 174-206.

14. The method of any one of embodiments 1-13, wherein the Cpf1 or Csm1 polypeptide forms a homodimer or heterodimer.

15. The method of any one of embodiments 1-14, wherein said plant cell is from a monocotyledonous species.

16. The method of any one of embodiments 1-14, wherein said plant cell is from a dicotyledonous species.

17. The method of any one of embodiments 1-16, wherein the expression of the Cpf1 or Csm1 polypeptide is under the control of an inducible or constitutive promoter.

18. The method of any one of embodiments 1-17, wherein the expression of the Cpf1 or Csm1 polypeptide is under the control of a cell type-specific or developmentally-preferred promoter.
19. The method of any one of embodiments 1-18, wherein the PAM sequence comprises 5'-TTN, wherein N can be any nucleotide.
20. The method of any one of embodiments 1-19, wherein said nucleotide sequence at a target site in the genome of a cell encodes an SBPase, FBPase, FBP aldolase, AGPase large subunit, AGPase small subunit, sucrose phosphate synthase, starch synthase, PEP carboxylase, pyruvate phosphate dikinase, transketolase, rubisco small subunit, or rubisco activase protein, or encodes a transcription factor that regulates the expression of one or more genes encoding an SBPase, FBPase, FBP aldolase, AGPase large subunit, AGPase small subunit, sucrose phosphate synthase, starch synthase, PEP carboxylase, pyruvate phosphate dikinase, transketolase, rubisco small subunit, or rubisco activase protein.
21. The method of any one of embodiments 1-20, the method further comprising contacting the target site with a donor polynucleotide, wherein the donor polynucleotide, a portion of the donor polynucleotide, a copy of the donor polynucleotide, or a portion of a copy of the donor polynucleotide integrates into the target DNA.
22. The method of any one of embodiments 1-21, wherein the target DNA is modified such that nucleotides within the target DNA are deleted.
23. The method of any one of embodiments 1-22, wherein said polynucleotide encoding a Cpf1 or Csm1 polypeptide is codon optimized for expression in a plant cell.
24. The method of any one of embodiments 1-23, wherein the expression of said nucleotide sequence is increased or decreased.
25. The method of any one of embodiments 1-24, wherein the polynucleotide encoding a Cpf1 or Csm1 polypeptide is operably linked to a promoter that is constitutive, cell specific, inducible, or activated by alternative splicing of a suicide exon.
26. The method of any one of embodiments 1-25, wherein said Cpf1 or Csm1 polypeptide comprises one or more mutations that reduce or eliminate the nuclease activity of said Cpf1 or Csm1 polypeptide.
27. The method of embodiment 26, wherein said mutated Cpf1 or Csm1 polypeptide comprises a mutation in a position corresponding to positions 917 or 1006 of FnCpf1 (SEQ ID NO:3) or to positions 701 or 922 of SmCsm1 (SEQ ID NO:160) when aligned for maximum identity, or wherein said mutated Cpf1 or Csm1 polypeptide comprises a mutation at positions 917 and 1006 of FnCpf1 (SEQ ID NO:3) or positions 701 and 922 of SmCsm1 (SEQ ID NO:160) when aligned for maximum identity.
28. The method of embodiment 27, wherein said mutations in positions corresponding to positions 917 or 1006 of FnCpf1 (SEQ ID NO: 3) are D917A and E1006A, respectively, or wherein said mutations in positions corresponding to positions 701 or 922 of SmCsm1 (SEQ ID NO:160) are D701A and E922A, respectively.
29. The method of any one of embodiments 26-28, wherein said mutated Cpf1 or Csm1 polypeptide comprises the amino acid sequence set forth in the group of SEQ ID NOs: 26-41 and 63-70.
30. The method of any one of embodiments 26-29, wherein the mutated Cpf1 or Csm1 polypeptide is fused to a transcriptional activation domain.
31. The method of embodiment 30, wherein the mutated Cpf1 or Csm1 polypeptide is directly fused to a transcriptional activation domain or fused to a transcriptional activation domain with a linker.
32. The method of any one of embodiments 26-29, wherein the mutated Cpf1 or Csm1 polypeptide is fused to a transcriptional repressor domain.
33. The method of embodiment 32, wherein the mutated Cpf1 or Csm1 polypeptide is fused to a transcriptional repressor domain with a linker.
34. The method of any one of embodiments 1-33 wherein said Cpf1 or Csm1 polypeptide further comprises a nuclear localization signal.
35. The method of embodiment 34 wherein said nuclear localization signal comprises SEQ ID NO:1, or is encoded by SEQ ID NO:2.
36. The method of any one of embodiments 1-33 wherein said Cpf1 or Csm1 polypeptide further comprises a chloroplast signal peptide.
37. The method of any one of embodiments 1-33 wherein said Cpf1 or Csm1 polypeptide further comprises a mitochondrial signal peptide.
38. The method of any one of embodiments 1-33 wherein said Cpf1 or Csm1 polypeptide further comprises a signal peptide that targets said Cpf1 or Csm1 polypeptide to multiple subcellular locations.
39. A nucleic acid molecule comprising a polynucleotide sequence encoding a Cpf1 or Csm1 polypeptide, wherein said polynucleotide sequence has been codon optimized for expression in a plant cell.
40. A nucleic acid molecule comprising a polynucleotide sequence encoding a Cpf1 or Csm1 polypeptide, wherein said polynucleotide sequence has been codon optimized for expression in a eukaryotic cell.
41. A nucleic acid molecule comprising a polynucleotide sequence encoding a Cpf1 or Csm1 polypeptide, wherein said polynucleotide sequence has been codon optimized for expression in a prokaryotic cell, wherein said prokaryotic cell is not the natural host of said Cpf1 or Csm1 polypeptide.
42. The nucleic acid molecule of any one of embodiments 39-41, wherein said polynucleotide sequence is selected from the group consisting of: SEQ ID NOs: 4, 5, 7, 8, 10, 11, 13, 14, 16, 17, 19, 21, 22, 24, 25, and 174-206 or a fragment or variant thereof, or wherein said polynucleotide sequence encodes a Cpf1 or Csm1 polypeptide selected from the group consisting of SEQ ID NOs: 3, 6, 9, 12, 15, 18, 20, 23, 106-173, and 230-236, and wherein said polynucleotide sequence encoding a Cpf1 or Csm1 polypeptide is operably linked to a promoter that is heterologous to the polynucleotide sequence encoding a Cpf1 or Csm1 polypeptide.
43. The nucleic acid molecule of any one of embodiments 39-41, wherein said variant polynucleotide sequence has at least 70% sequence identity to a polynucleotide sequence selected from the group consisting of: SEQ ID NOs: 4, 5, 7, 8, 10, 11, 13, 14, 16, 17, 19, 21, 22, 24, 25, and 174-206, or wherein said polynucleotide sequence encodes a Cpf1 or Csm1 polypeptide that has at least 80% sequence identity to a polypeptide selected from the group consisting of SEQ ID NOs: 3, 6, 9, 12, 15, 18, 20, 23, 106-173, and 230-236, and wherein said polynucleotide sequence encoding a Cpf1 or Csm1 polypeptide is operably linked to a promoter that is heterologous to the polynucleotide sequence encoding a Cpf1 or Csm1 polypeptide.

44. The nucleic acid molecule of any one of embodiments 39-41, wherein said Cpf1 or Csm1 polypeptide comprises an amino acid sequence selected from the group consisting of: SEQ ID NOs: 3, 6, 9, 12, 15, 18, 20, 23, 106-173, and 230-236, or a fragment or variant thereof.

45. The nucleic acid molecule of embodiment 44, wherein said variant polypeptide sequence has at least 70% sequence identity to a polypeptide sequence selected from the group consisting of: SEQ ID NOs: 3, 6, 9, 12, 15, 18, 20, 23, 106-173, and 230-236.

46. The nucleic acid molecule of any one of embodiments 39-45, wherein said polynucleotide sequence encoding a Cpf1 or Csm1 polypeptide is operably linked to a promoter that is active in a plant cell.

47. The nucleic acid molecule of any one of embodiments 39-45, wherein said polynucleotide sequence encoding a Cpf1 or Csm1 polypeptide is operably linked to a promoter that is active in a eukaryotic cell.

48. The nucleic acid molecule of any one of embodiments 39-45, wherein said polynucleotide sequence encoding a Cpf1 or Csm1 polypeptide is operably linked to a promoter that is active in a prokaryotic cell.

49. The nucleic acid molecule of any one of embodiments 39-45, wherein said polynucleotide sequence encoding a Cpf1 or Csm1 polypeptide is operably linked to a constitutive promoter, inducible promoter, cell type-specific promoter, or developmentally-preferred promoter.

50. The nucleic acid molecule of any one of embodiments 39-45, wherein said nucleic acid molecule encodes a fusion protein comprising said Cpf1 or Csm1 polypeptide and an effector domain.

51. The nucleic acid molecule of embodiment 50, wherein said effector domain is selected from the group consisting of: transcriptional activator, transcriptional repressor, nuclear localization signal, and cell penetrating signal.

52. The nucleic acid molecule of embodiment 51, wherein said Cpf1 or Csm1 polypeptide is mutated to reduce or eliminate nuclease activity.

53. The nucleic acid molecule of embodiment 52, wherein said mutated Cpf1 or Csm1 polypeptide comprises a mutation in a position corresponding to positions 917 or 1006 of FnCpf1 (SEQ ID NO:3) or to positions 701 or 922 of SmCsm1 (SEQ ID NO:160) when aligned for maximum identity, or wherein said mutated Cpf1 or Csm1 polypeptide comprises a mutation at positions corresponding to positions 917 and 1006 of FnCpf1 (SEQ ID NO:3) or positions 701 and 922 of SmCsm1 (SEQ ID NO:160) when aligned for maximum identity.

54. The nucleic acid molecule of any one of embodiments 50-53, wherein said Cpf1 or Csm1 polypeptide is fused to said effector domain with a linker.

55. The nucleic acid molecule of any one of embodiments 39-54, wherein said Cpf1 or Csm1 polypeptide forms a dimer.

56. A fusion protein encoded by the nucleic acid molecule of any one of embodiments 50-55.

57. A Cpf1 or Csm1 polypeptide encoded by the nucleic acid molecule of any one of embodiments 39-45.

58. A Cpf1 or Csm1 polypeptide mutated to reduce or eliminate nuclease activity.

59. The Cpf1 or Csm1 polypeptide of embodiment 58, wherein said mutated Cpf1 or Csm1 polypeptide comprises a mutation in a position corresponding to positions 917 or 1006 of FnCpf1 (SEQ ID NO:3) or to positions 701 or 922 of SmCsm1 (SEQ ID NO:160) when aligned for maximum identity or wherein said mutated Cpf1 or Csm1 polypeptide comprises mutations at positions corresponding to positions 917 and 1006 of FnCpf1 (SEQ ID NO:3) or positions 701 and 922 of SmCsm1 (SEQ ID NO:160) when aligned for maximum identity.

60. A plant cell, eukaryotic cell, or prokaryotic cell comprising the nucleic acid molecule of any one of embodiments 39-55.

61. A plant cell, eukaryotic cell, or prokaryotic cell comprising the fusion protein or polypeptide of any one of embodiments 56-59.

62. A plant cell produced by the method of any one of embodiments 1 and 3-38.

63. A plant comprising the nucleic acid molecule of any one of embodiments 39-55.

64. A plant comprising the fusion protein or polypeptide of any one of embodiments 56-59.

65. A plant produced by the method of any one of embodiments 1 and 3-38.

66. The seed of the plant of any one of embodiments 63-65.

67. The method of any one of embodiments 1 and 3-38 wherein said modified nucleotide sequence comprises insertion of a polynucleotide that encodes a protein conferring antibiotic or herbicide tolerance to transformed cells.

68. The method of embodiment 67 wherein said polynucleotide that encodes a protein conferring antibiotic or herbicide tolerance comprises SEQ ID NO:76, or encodes a protein that comprises SEQ ID NO:77.

69. The method of any one of embodiments 3-38 wherein said target site in the genome of a plant cell comprises SEQ ID NO:71, or shares at least 80% identity with a portion or fragment of SEQ ID NO:71.

70. The method of any one of embodiments 1-38 wherein said DNA polynucleotide encoding a DNA-targeting RNA comprises SEQ ID NO:73, SEQ ID NO:91, SEQ ID NO:92, SEQ ID NO:93, or SEQ ID NO:95.

71. The nucleic acid molecule of any one of embodiments 39-55 wherein said polynucleotide sequence encoding a Cpf1 or Csm1 polypeptide further comprises a polynucleotide sequence encoding a nuclear localization signal.

72. The nucleic acid molecule of embodiment 71 wherein said nuclear localization signal comprises SEQ ID NO:1 or is encoded by SEQ ID NO:2.

73. The nucleic acid molecule of any one of embodiments 39-55 wherein said polynucleotide sequence encoding a Cpf1 or Csm1 polypeptide further comprises a polynucleotide sequence encoding a chloroplast signal peptide.

74. The nucleic acid molecule of any one of embodiments 39-55 wherein said polynucleotide sequence encoding a Cpf1 or Csm1 polypeptide further comprises a polynucleotide sequence encoding a mitochondrial signal peptide.

75. The nucleic acid molecule of any one of embodiments 39-55 wherein said polynucleotide sequence encoding a Cpf1 or Csm1 polypeptide further comprises a polynucleotide sequence encoding a signal peptide that targets said Cpf1 or Csm1 polypeptide to multiple subcellular locations.

76. The fusion protein of embodiment 56 wherein said fusion protein further comprises a nuclear localization signal, chloroplast signal peptide, mitochondrial signal peptide, or signal peptide that targets said Cpf1 or Csm1 polypeptide to multiple subcellular locations.

77. The Cpf1 or Csm1 polypeptide of any one of embodiments 57-59 wherein said Cpf1 or Csm1 polypeptide further comprises a nuclear localization signal, chloroplast signal peptide, mitochondrial signal peptide, or signal peptide that targets said Cpf1 or Csm1 polypeptide to multiple subcellular locations.

The following examples are offered by way of illustration and not by way of limitation.

EXPERIMENTAL

Example 1—Cloning Cpf1 Constructs

Cpf1-containing constructs (Construct numbers 131306-131311 and 131313) are summarized in Table 1. Briefly, the cpf1 genes were de novo synthesized by GenScript (Piscataway, N.J.) and amplified by PCR to add an N-terminal SV40 nuclear localization tag (SEQ ID NO: 2) in frame with the cpf1 coding sequence of interest as well as restriction enzyme sites for cloning. Using the appropriate restriction enzyme sites, each individual cpf1 gene was cloned downstream of the 2×35s promoter (SEQ ID NO: 43).

Guide RNAs targeted to a region of DNA spanning the junction between the promoter and the 5' end of the GFP coding region were synthesized by Integrated DNA Technologies (Coralville, Iowa) as complete cassettes. Each cassette included a rice U3 promoter (SEQ ID NO:42) operationally linked to the appropriate gRNA (SEQ ID NOs:47-53) that was operationally linked to the rice U3 terminator (SEQ ID NO:44). While each gRNA was targeted to the same region of the promoter and GFP gene, each gRNA was designed to ensure that it included the appropriate scaffold to interact correctly with its respective Cpf1 enzyme.

Constructs were assembled and cloned into a modified pSB11 vector backbone containing the hptII gene that can confer hygromycin b resistance in plants (SEQ ID NO:45). The hptII gene was situated downstream from the maize ubiquitin promoter and 5'UTR (pZmUbi; SEQ ID NO:46).

to a constitutive promoter. Three infected calli showing high levels of GFP-derived fluorescence based on visual inspection were selected and divided into multiple sections. These sections were allowed to propagate on selection media. After the callus pieces were allowed to recover and grow larger, these calli were re-infected with *Agrobacterium* cells harboring genes encoding Cpf1 enzymes and their respective guide RNAs (gRNAs). Following infection with the cpf1-containing vectors, the calli were propagated on selection medium containing hygromycin b. Callus pieces that putatively expressed functional Cpf1 proteins were selected visually by inspecting the callus pieces for regions that were no longer visibly fluorescent. This loss of fluorescence was likely to result from successful Cpf1-mediated editing of the GFP-encoding sequence, resulting in a non-functional GFP gene. For example, rice callus transformed first with a GFP construct and then with construct 131307, containing a gene encoding the Cpf1 protein from *Acidaminococcus* sp. BV3L6 (SEQ ID NO: 8, encoding SEQ ID NO: 6) resulted in parts of the callus showing an apparent loss of GFP-derived fluorescence. Those rice callus pieces that contained clusters of cells that did not exhibit GFP-derived fluorescence were prioritized for more in-depth molecular characterization.

Example 3—T7EI Assay

The T7 endonuclease I (T7EI) assay is used to identify samples with insertions and/or deletions at the desired location and to assess targeting efficiency of genome editing enzymes. The assay protocol is modified from Shan et al (2014) Nature Protocols 9: 2395-2410. The basis of the assay is that T7EI recognizes and cleaves non-perfectly

TABLE 1

Cpf1 vectors

| Construct Number | Cpf1 promoter | Cpf1 gene[1] | Cpf1 Terminator | gRNA promoter | gRNA sequence | gRNA terminator |
|---|---|---|---|---|---|---|
| 131306 | 2X 35S (SEQ ID NO: 43) | *Francisella tularensis* subsp. *novicida* U112 (SEQ ID NO: 5) | 35S poly A (SEQ ID NO: 54) | rice U3 (SEQ ID NO: 42) | *Francisella* GFP gRNA (SEQ ID NO: 47) | rice U3 (SEQ ID NO: 44) |
| 131307 | 2X 35S (SEQ ID NO: 43) | *Acidaminococcus* sp. BV3L6 (SEQ ID NO: 8) | 35S poly A (SEQ ID NO: 54) | rice U3 (SEQ ID NO: 42) | *Acidaminococcus* GFP gRNA (SEQ ID NO: 48) | rice U3 (SEQ ID NO: 44) |
| 131308 | 2X 35S (SEQ ID NO: 43) | Lachnospiraceae bacterium MA2020 (SEQ ID NO: 11) | 35S poly A (SEQ ID NO: 54) | rice U3 (SEQ ID NO: 42) | LachnosMA2020 GFP gRNA (SEQ ID NO: 49) | rice U3 (SEQ ID NO: 44) |
| 131309 | 2X 35S (SEQ ID NO: 43) | *Candidatus Methanoplasma termitum* (SEQ ID NO: 14) | 35S poly A (SEQ ID NO: 54) | rice U3 (SEQ ID NO: 42) | *Candidatus* GFP gRNA (SEQ ID NO: 50) | rice U3 (SEQ ID NO: 44) |
| 131310 | 2X 35S (SEQ ID NO: 43) | *Moraxella bovoculi* 237 (SEQ ID NO: 17) | 35S poly A (SEQ ID NO: 54) | rice U3 (SEQ ID NO: 42) | *Moraxella* GFP gRNA (SEQ ID NO: 51) | rice U3 (SEQ ID NO: 44) |
| 131311 | 2X 35S (SEQ ID NO: 43) | Lachnospiraceae bacterium ND2006 (SEQ ID NO: 19) | 35S poly A (SEQ ID NO: 54) | rice U3 (SEQ ID NO: 42) | LanchnosND2006 GFP gRNA (SEQ ID NO: 52) | rice U3 (SEQ ID NO: 44) |
| 131313 | 2X 35S (SEQ ID NO: 43) | *Prevotella disiens* (SEQ ID NO: 25) | 35S poly A (SEQ ID NO: 54) | rice U3 (SEQ ID NO: 42) | Prevo GFP gRNA (SEQ ID NO: 53) | rice U3 (SEQ ID NO: 44) |

[1]Each cpf1 gene was fused in-frame with the SV40 nuclear localization signal (SEQ ID NO: 2, encoding the amino acid sequence of SEQ ID NO: 1) at its 5' end.

Example 2—*Agrobacterium*-Mediated Rice Transformation

Rice (*Oryza sativa* cv. Kitaake) calli were infected with *Agrobacterium* cells harboring a super binary plasmid that contained a gene encoding green fluorescent protein (GFP; SEQ ID NO: 55 encoding SEQ ID NO: 56) operably linked matched DNA. Briefly, a PCR reaction is performed to amplify a region of DNA that contains the DNA sequence targeted by the gRNA. As both edited and unedited DNA are expected to be included in the sample, a mixture of PCR products is obtained. The PCR products are melted and then allowed to re-anneal. When an unedited PCR product re-anneals with an edited PCR product, a DNA mismatch results. These DNA mismatches are digested by T7EI and can be identified by gel-based assays. DNA is extracted from rice callus that appeared to exhibit a loss of GFP-derived fluorescence. PCR is performed with this DNA as a template using primers designed to amplify a region of DNA spanning the junction between the promoter and the GFP open reading frame. PCR products are melted and re-annealed, then digested with T7EI (New England Biolabs, Ipswich, Mass.) according to the manufacturer's protocol. The resulting DNA is electrophoresed on a 2% agarose gel. In those samples where Cpf1 produced an insertion or deletion at the desired location, the initial band is digested to produce two smaller bands.

Example 4—Sequencing of DNA from Rice Callus

DNA extracted from rice callus that appeared, based on visual inspection for loss of fluorescence and/or based on results of T7EI assays, to comprise genomic DNA edited as a result of the accumulation of functional Cpf1 enzyme is selected for sequence-based analysis. DNA is extracted from the appropriate rice callus pieces and primers are used to PCR-amplify the GFP coding sequence from this DNA. The resulting PCR products are cloned into plasmids that are subsequently transformed into *E. coli* cells. These plasmids are recovered and Sanger sequencing is used to analyze the DNA to identify insertions, deletions, and/or point mutations in the GFP-encoding DNA.

Example 5—Using Deactivated Cpf1 Proteins to Modulate Gene Expression

The RuvC-like domain of Cpf1 has been shown to mediate DNA cleavage (Zetsche et al (2015) *Cell* 163: 759-771), with specific residues identified in the Cpf1 enzyme from *Francisella tularensis* subsp. *novicida* U112 (i.e., D917 and E1006) that completely inactivated DNA cleavage activity when mutated from the native amino acid to alanine. Amino-acid based alignments using Clustal W Multiple Alignment (Thompson et al (1994) *Nucleic Acid Research* 22: 4673-4680) of the eight Cpf1 enzymes investigated here were performed to identify the corresponding amino acid residues in the other enzymes. Table 2 lists these amino acid residues. The amino acid sequences of deactivated Cpf1 proteins corresponding to point mutations at each of the amino acid residues listed in Table 2 are found in SEQ ID NOs: 26-41. The amino acid sequences of the double mutant deactivated Cpf1 proteins comprising mutations at both residues listed for each cpf1 protein in Table 2 are found in SEQ ID NOs: 63-70.

TABLE 2 amino acid residues mutated to generate deactivated Cpf1 enzymes

| Protein | First a.a. | Second a.a. |
|---|---|---|
| FnCpf1 (SEQ ID NO: 3) | D917 | E1006 |
| AsCpf1 (SEQ ID NO: 6) | D908 | E993 |
| Lb2Cpf1 (SEQ ID NO: 9) | D815 | E906 |
| CMtCpf1 (SEQ ID NO: 12) | D859 | E944 |
| MbCpf1 (SEQ ID NO: 15) | D986 | E1080 |
| LbCpf1 (SEQ ID NO: 18) | D832 | E925 |
| PcCpf1 (SEQ ID NO: 20) | D878 | E963 |
| PdCpf1 (SEQ ID NO: 23) | D943 | E1032 |

Appropriate primers are designed so that Quikchange PCR (Agilent Technologies, Santa Clara, Calif.) can be performed to produce genes that encode the deactivated Cpf1 sequences listed in SEQ ID NOs: 26-41 and to produce genes that encode the deactivated Cpf1 sequences listed in SEQ ID NOs: 63-70. PCR is performed to produce genes that encode a fusion protein containing a deactivated Cpf1 protein fused to a gene expression activation or repression domain such as the EDLL or TAL activation domains or the SRDX repressor domain, with the SV40 nuclear localization signal (SEQ ID NO:2, encoding SEQ ID NO:1) fused in frame at the 5' end of the gene. Guide RNAs (gRNAs) are designed to allow the gRNA to interact with the deactivated Cpf1 protein and to guide the deactivated Cpf1 protein to a desired location in a plant genome. Cassettes containing the gRNA(s) of interest, operably linked to promoter(s) operable in plant cells, and containing the gene(s) encoding Cpf1 fusion protein(s) fused to activation and/or repression domain(s), are cloned into a vector suitable for plant transformation. This vector is transformed into a plant cell, resulting in production of the gRNA(s) and the Cpf1 fusion protein(s) in the plant cell. The fusion protein containing the deactivated Cpf1 protein and the activator or repressor domain effects a modulation of the expression of nearby genes in the plant genome.

Example 6—Editing Pre-Determined Genomic Loci in Maize (*Zea mays*)

One or more gRNAs is designed to anneal with a desired site in the maize genome and to allow for interaction with one or more Cpf1 or Csm1 proteins. These gRNAs are cloned in a vector such that they are operably linked to a promoter that is operable in a plant cell (the "gRNA cassette"). One or more genes encoding a Cpf1 or Csm1 protein is cloned in a vector such that they are operably linked to a promoter that is operable in a plant cell (the "cpf1 cassette" or "csm1 cassette"). The gRNA cassette and the cpf1 cassette or csm1 cassette are each cloned into a vector that is suitable for plant transformation, and this vector is subsequently transformed into *Agrobacterium* cells. These cells are brought into contact with maize tissue that is suitable for transformation. Following this incubation with the *Agrobacterium* cells, the maize cells are cultured on a tissue culture medium that is suitable for regeneration of intact plants. Maize plants are regenerated from the cells that were brought into contact with *Agrobacterium* cells harboring the vector that contained the cpf1 or csm1 cassette and gRNA cassette. Following regeneration of the maize plants, plant tissue is harvested and DNA is extracted from the tissue. T7EI assays and/or sequencing assays are performed, as appropriate, to determine whether a change in the DNA sequence has occurred at the desired genomic location.

Alternatively, particle bombardment is used to introduce the cpf1 or csm1 cassette and gRNA cassette into maize cells. Vectors containing a cpf1 or csm1 cassette and a gRNA cassette are coated onto gold beads or titanium beads that are then used to bombard maize tissue that is suitable for regeneration. Following bombardment, the maize tissue is transferred to tissue culture medium for regeneration of maize plants. Following regeneration of the maize plants, plant tissue is harvested and DNA is extracted from the tissue. T7EI assays and/or sequencing assays are performed, as appropriate, to determine whether a change in the DNA sequence has occurred at the desired genomic location.

Example 7—Editing Pre-Determined Genomic Loci in *Setaria viridis*

One or more gRNAs is designed to anneal with a desired site in the *Setaria viridis* genome and to allow for interaction with one or more Cpf1 or Csm1 proteins. These gRNAs are cloned in a vector such that they are operably linked to a promoter that is operable in a plant cell (the "gRNA cassette"). One or more genes encoding a Cpf1 or Csm1 protein is cloned in a vector such that they are operably linked to a promoter that is operable in a plant cell (the "cpf1 cassette" or "csm1 cassette"). The gRNA cassette and the cpf1 cassette or csm1 cassette are each cloned into a vector that is suitable for plant transformation, and this vector is subsequently transformed into *Agrobacterium* cells. These cells are brought into contact with *Setaria viridis* tissue that is suitable for transformation. Following this incubation with the *Agrobacterium* cells, the *Setaria viridis* cells are cultured on a tissue culture medium that is suitable for regeneration of intact plants. *Setaria viridis* plants are regenerated from the cells that were brought into contact with *Agrobacterium* cells harboring the vector that contained the cpf1 cassette or csm1 cassette and gRNA cassette. Following regeneration of the *Setaria viridis* plants, plant tissue is harvested and DNA is extracted from the tissue. T7EI assays and/or sequencing assays are performed, as appropriate, to determine whether a change in the DNA sequence has occurred at the desired genomic location.

Alternatively, particle bombardment is used to introduce the cpf1 cassette or csm1 cassette and gRNA cassette into *S. viridis* cells. Vectors containing a cpf1 cassette or csm1 cassette and a gRNA cassette are coated onto gold beads or titanium beads that are then used to bombard *S. viridis* tissue that is suitable for regeneration. Following bombardment, the *S. viridis* tissue is transferred to tissue culture medium for regeneration of intact plants. Following regeneration of the plants, plant tissue is harvested and DNA is extracted from this tissue. T7EI assays and/or sequencing assays are performed, as appropriate, to determine whether a change in the DNA sequence has occurred at the desired genomic location.

Example 8—Deleting DNA from a Pre-Determined Genomic Locus

A first gRNA is designed to anneal with a first desired site in the genome of a plant of interest and to allow for interaction with one or more Cpf1 or Csm1 proteins. A second gRNA is designed to anneal with a second desired site in the genome of a plant of interest and to allow for interaction with one or more Cpf1 or Csm1 proteins. Each of these gRNAs is operably linked to a promoter that is operable in a plant cell and is subsequently cloned into a vector that is suitable for plant transformation. One or more genes encoding a Cpf1 or Csm1 protein is cloned in a vector such that they are operably linked to a promoter that is operable in a plant cell (the "cpf1 cassette" or "csm1 cassette"). The cpf1 cassette or csm1 cassette and the gRNA cassettes are cloned into a single plant transformation vector that is subsequently transformed into *Agrobacterium* cells. These cells are brought into contact with plant tissue that is suitable for transformation. Following this incubation with the *Agrobacterium* cells, the plant cells are cultured on a tissue culture medium that is suitable for regeneration of intact plants. Alternatively, the vector containing the cpf1 cassette or csm1 cassette and the gRNA cassettes is coated onto gold or titanium beads suitable for bombardment of plant cells. The cells are bombarded and are then transferred to tissue culture medium that is suitable for the regeneration of intact plants. The gRNA-Cpf1 or gRNA-Csm1 complexes effect double-stranded breaks at the desired genomic loci and in some cases the DNA repair machinery causes the DNA to be repaired in such a way that the native DNA sequence that was located between the two targeted genomic loci is deleted. Plants are regenerated from the cells that are brought into contact with *Agrobacterium* cells harboring the vector that contains the cpf1 cassette or csm1 cassette and gRNA cassettes or are bombarded with beads coated with this vector. Following regeneration of the plants, plant tissue is harvested and DNA is extracted from the tissue. T7EI assays and/or sequencing assays are performed, as appropriate, to determine whether DNA has been deleted from the desired genomic location or locations.

Example 9—Inserting DNA at a Pre-Determined Genomic Locus

A gRNA is designed to anneal with a desired site in the genome of a plant of interest and to allow for interaction with one or more Cpf1 or Csm1 proteins. The gRNA is operably linked to a promoter that is operable in a plant cell and is subsequently cloned into a vector that is suitable for plant transformation. One or more genes encoding a Cpf1 or Csm1 protein is cloned in a vector such that they are operably linked to a promoter that is operable in a plant cell (the "cpf1 cassette" or "csm1 cassette"). The cpf1 cassette or csm1 cassette and the gRNA cassette are both cloned into a single plant transformation vector that is subsequently transformed into *Agrobacterium* cells. These cells are brought into contact with plant tissue that is suitable for transformation. Concurrently, donor DNA is introduced into these same plant cells. Said donor DNA includes a DNA molecule that is to be inserted at the desired site in the plant genome, flanked by upstream and downstream flanking regions. The upstream flanking region is homologous to the region of genomic DNA upstream of the genomic locus targeted by the gRNA, and the downstream flanking region is homologous to the region of genomic DNA downstream of the genomic locus targeted by the gRNA. The upstream and downstream flanking regions mediate the insertion of DNA into the desired site of the plant genome. Following this incubation with the *Agrobacterium* cells and introduction of the donor DNA, the plant cells are cultured on a tissue culture medium that is suitable for regeneration of intact plants. Plants are regenerated from the cells that were brought into contact with *Agrobacterium* cells harboring the vector that contained the cpf1 cassette or csm1 cassette and gRNA cassettes. Following regeneration of the plants, plant tissue is harvested and DNA is extracted from the tissue. T7EI assays and/or sequencing assays are performed, as appropriate, to determine whether DNA has been inserted at the desired genomic location or locations.

Example 10—Biolistically Inserting DNA at the Rice CAO1 Genomic Locus

For biolistic insertion of DNA at a pre-determined genomic locus, vectors were designed with cpf1 cassettes or csm1 cassettes. These vectors contained a 2×35S promoter (SEQ ID NO:43) upstream of the cpf1 or csm1 ORF and a 35S polyA terminator sequence (SEQ ID NO:54) downstream of the cpf1 or csm1 ORF. Table 3 summarizes these cpf1 and csm1 vectors.

TABLE 3

Summary of cpf1 and csm1 vectors used for biolistic experiments

| Vector Number | Promoter | Cpf1 or Csm1 ORF Source | Terminator |
|---|---|---|---|
| 131272 (SEQ ID NO: 81) | 2X35S (SEQ ID NO: 43) | *Francisella tularensis* (SEQ ID NO: 5) | 35S polyA (SEQ ID NO: 54) |
| 131273 (SEQ ID NO: 82) | 2X35S (SEQ ID NO: 43) | *Acidaminococcus* sp. (SEQ ID NO: 8) | 35S polyA (SEQ ID NO: 54) |
| 131274 (SEQ ID NO: 83) | 2X35S (SEQ ID NO: 43) | *Lachnospiraceae bacterium* MA2020 (SEQ ID NO: 11) | 35S polyA (SEQ ID NO: 54) |
| 131275 (SEQ ID NO: 84) | 2X35S (SEQ ID NO: 43) | *Candidatus Methanoplasma termitum* (SEQ ID NO: 14) | 35S polyA (SEQ ID NO: 54) |
| 131276 (SEQ ID NO: 85) | 2X35S (SEQ ID NO: 43) | *Moraxella bovoculi* 237 (SEQ ID NO: 17) | 35S polyA (SEQ ID NO: 54) |
| 131277 (SEQ ID NO: 86) | 2X35S (SEQ ID NO: 43) | *Lachnospiraceae bacterium* ND2006 (SEQ ID NO: 19) | 35S polyA (SEQ ID NO: 54) |
| 131278 (SEQ ID NO: 87) | 2X35S (SEQ ID NO: 43) | *Porphyromonas crevioricanis* (SEQ ID NO: 22) | 35S polyA (SEQ ID NO: 54) |
| 131279 (SEQ ID NO: 88) | 2X35S (SEQ ID NO: 43) | *Prevotella disiens* (SEQ ID NO: 25) | 35S polyA (SEQ ID NO: 54) |
| 132058 | 2X35S (SEQ ID NO: 43) | *Anaerovibrio* sp. RM50 (SEQ ID NO: 176) | 35S polyA (SEQ ID NO: 54) |
| 132059 | 2X35S (SEQ ID NO: 43) | *Lachnospiraceae bacterium* MC2017 (SEQ ID NO: 174) | 35S polyA (SEQ ID NO: 54) |
| 132065 | 2X35S (SEQ ID NO: 43) | *Moraxella caprae* DSM 19149 (SEQ ID NO: 175) | 35S polyA (SEQ ID NO: 54) |
| 132066 | 2X35S (SEQ ID NO: 43) | *Succinivibrio dextrinosolvens* H5 (SEQ ID NO: 177) | 35S polyA (SEQ ID NO: 54) |
| 132067 | 2X35S (SEQ ID NO: 43) | *Prevotella bryantii* B14 (SEQ ID NO: 179) | 35S polyA (SEQ ID NO: 54) |
| 132068 | 2X35S (SEQ ID NO: 43) | *Flavobacterium branchiophilum* FL-15 (SEQ ID NO: 178) | 35S polyA (SEQ ID NO: 54) |
| 132075 | 2X35S (SEQ ID NO: 43) | *Lachnospiraceae bacterium* NC2008 (SEQ ID NO: 180) | 35S polyA (SEQ ID NO: 54) |
| 132082 | 2X35S (SEQ ID NO: 43) | *Pseudobutyrivibrio ruminis* (SEQ ID NO: 181) | 35S polyA (SEQ ID NO: 54) |
| 132083 | 2X35S (SEQ ID NO: 43) | *Helcococcus kunzii* ATCC 51366 (SEQ ID NO: 183) | 35S polyA (SEQ ID NO: 54) |
| 132084 | 2X35S (SEQ ID NO: 43) | *Smithella* sp. SCADC (SEQ ID NO: 185) | 35S polyA (SEQ ID NO: 54) |
| 132095 | 2X35S (SEQ ID NO: 43) | Uncultured bacterium (gcode 4) ACD__3C00058 (SEQ ID NO: 187) | 35S polyA (SEQ ID NO: 54) |
| 132096 | 2X35S (SEQ ID NO: 43) | *Proteocatella sphenisci* (SEQ ID NO: 191) | 35S polyA (SEQ ID NO: 54) |
| 132098 | 2X35S (SEQ ID NO: 43) | Candidate division WS6 bacterium GW2011_GWA2_37_6 US52_C0007 (SEQ ID NO: 182) | 35S polyA (SEQ ID NO: 54) |
| 132099 | 2X35S (SEQ ID NO: 43) | *Butyrivibrio* sp. NC3005 (SEQ ID NO: 190) | 35S polyA (SEQ ID NO: 54) |
| 132105 | 2X35S (SEQ ID NO: 43) | *Flavobacterium* sp. 316 (SEQ ID NO: 196) | 35S polyA (SEQ ID NO: 54) |
| 132100 | 2X35S (SEQ ID NO: 43) | *Butyrivibrio fibrisolvens* (SEQ ID NO: 192) | 35S polyA (SEQ ID NO: 54) |
| 132094 | 2X35S (SEQ ID NO: 43) | Bacteroidetes oral taxon 274 str. F0058 (SEQ ID NO: 188) | 35S polyA (SEQ ID NO: 54) |
| 132093 | 2X35S (SEQ ID NO: 43) | *Lachnospiraceae bacterium* COE1 (SEQ ID NO: 189) | 35S polyA (SEQ ID NO: 54) |
| 132111 | 2X35S (SEQ ID NO: 43) | Parcubacteria bacterium GW2011 (SEQ ID NO: 197) | 35S polyA (SEQ ID NO: 54) |
| 132092 | 2X35S (SEQ ID NO: 43) | *Sulfuricurvum* sp. PC08-66 (SEQ ID NO: 186) | 35S polyA (SEQ ID NO: 54) |
| 132097 | 2X35S (SEQ ID NO: 43) | *Candidatus Methanomethylophilus alvus* Mx1201 (SEQ ID NO: 184) | 35S polyA (SEQ ID NO: 54) |
| 132106 | 2X35S (SEQ ID NO: 43) | *Eubacterium* sp. (SEQ ID NO: 200) | 35S polyA (SEQ ID NO: 54) |
| 132107 | 2X35S (SEQ ID NO: 43) | Microgenomates (Roizmanbacteria) bacterium GW2011_GWA2_37_7 (SEQ ID NO: 201) | 35S polyA (SEQ ID NO: 54) |
| 132102 | 2X35S (SEQ ID NO: 43) | Microgenomates (Roizmanbacteria) bacterium GW2011_GWA2_37_7 (SEQ ID NO: 193) | 35S polyA (SEQ ID NO: 54) |
| 132104 | 2X35S (SEQ ID NO: 43) | *Prevotella brevis* ATCC 19188 (SEQ ID NO: 199) | 35S polyA (SEQ ID NO: 54) |
| 132109 | 2X35S (SEQ ID NO: 43) | *Smithella* sp. SCADC (SEQ ID NO: 203) | 35S polyA (SEQ ID NO: 54) |
| 132101 | 2X35S (SEQ ID NO: 43) | *Oribacterium* sp. NK2B42 (SEQ ID NO: 194) | 35S polyA (SEQ ID NO: 54) |

TABLE 3-continued

Summary of cpf1 and csm1 vectors used for biolistic experiments

| Vector Number | Promoter | Cpf1 or Csm1 ORF Source | Terminator |
|---|---|---|---|
| 132103 | 2X35S (SEQ ID NO: 43) | *Synergistes jonesii* strain 78-1 (SEQ ID NO: 195) | 35S polyA (SEQ ID NO: 54) |
| 132108 | 2X35S (SEQ ID NO: 43) | *Smithella* sp. SC_K08D17 (SEQ ID NO: 202) | 35S polyA (SEQ ID NO: 54) |
| 132110 | 2X35S (SEQ ID NO: 43) | *Prevotella albensis* (SEQ ID NO: 198) | 35S polyA (SEQ ID NO: 54) |
| 132143 | 2X35S (SEQ ID NO: 43) | *Moraxella lacunata* (SEQ ID NO: 206) | 35S polyA (SEQ ID NO: 54) |
| 132144 | 2X35S (SEQ ID NO: 43) | *Eubacterium coprostanoligenes* (SEQ ID NO: 205) | 35S polyA (SEQ ID NO: 54) |
| 132145 | 2X35S (SEQ ID NO: 43) | *Succiniclasticum ruminis* (SEQ ID NO: 204) | 35S polyA (SEQ ID NO: 54) |

In addition to the cpf1 and csm1 vectors described in Table 3, vectors with gRNA cassettes were designed such that the gRNA would anneal with a region of the CAO1 gene locus in the rice (*Oryza sativa*) genome (SEQ ID NO:71) and would also allow for interaction with the appropriate Cpf1 or Csm1 protein. In these vectors, the gRNA was operably linked to the rice U6 promoter (SEQ ID NO:72) and terminator (SEQ ID NO:74). Table 4 summarizes these gRNA vectors.

TABLE 4

Summary of gRNA vectors used for biolistic experiments at the rice CAO1 genomic locus

| Vector | Promoter | gRNA | Terminator |
|---|---|---|---|
| 131608 | OsU6 (SEQ ID NO: 72) | SEQ ID NO: 73 | OsU6 Terminator (SEQ ID NO: 74) |
| 131609 | OsU6 (SEQ ID NO: 72) | SEQ ID NO: 91 | OsU6 Terminator (SEQ ID NO: 74) |
| 131610 | OsU6 (SEQ ID NO: 72) | SEQ ID NO: 92 | OsU6 Terminator (SEQ ID NO: 74) |
| 131611 | OsU6 (SEQ ID NO: 72) | SEQ ID NO: 93 | OsU6 Terminator (SEQ ID NO: 74) |
| 131612 | OsU6 (SEQ ID NO: 72) | SEQ ID NO: 94 | OsU6 Terminator (SEQ ID NO: 74) |
| 131613 | OsU6 (SEQ ID NO: 72) | SEQ ID NO: 95 | OsU6 Terminator (SEQ ID NO: 74) |
| 131912 | OsU6 (SEQ ID NO: 72) | SEQ ID NO: 207 | OsU6 Terminator (SEQ ID NO: 74) |
| 131913 | OsU6 (SEQ ID NO: 72) | SEQ ID NO: 208 | OsU6 Terminator (SEQ ID NO: 74) |
| 131914 | OsU6 (SEQ ID NO: 72) | SEQ ID NO: 209 | OsU6 Terminator (SEQ ID NO: 74) |
| 131980 | OsU6 (SEQ ID NO: 72) | SEQ ID NO: 210 | OsU6 Terminator (SEQ ID NO: 74) |
| 131981 | OsU6 (SEQ ID NO: 72) | SEQ ID NO: 211 | OsU6 Terminator (SEQ ID NO: 74) |
| 131982 | OsU6 (SEQ ID NO: 72) | SEQ ID NO: 212 | OsU6 Terminator (SEQ ID NO: 74) |
| 131983 | OsU6 (SEQ ID NO: 72) | SEQ ID NO: 213 | OsU6 Terminator (SEQ ID NO: 74) |
| 131984 | OsU6 (SEQ ID NO: 72) | SEQ ID NO: 214 | OsU6 Terminator (SEQ ID NO: 74) |
| 131985 | OsU6 (SEQ ID NO: 72) | SEQ ID NO: 215 | OsU6 Terminator (SEQ ID NO: 74) |
| 131986 | OsU6 (SEQ ID NO: 72) | SEQ ID NO: 216 | OsU6 Terminator (SEQ ID NO: 74) |
| 132033 | OsU6 (SEQ ID NO: 72) | SEQ ID NO: 228 | OsU6 Terminator (SEQ ID NO: 74) |
| 132051 | OsU6 (SEQ ID NO: 72) | SEQ ID NO: 217 | OsU6 Terminator (SEQ ID NO: 74) |
| 132052 | OsU6 (SEQ ID NO: 72) | SEQ ID NO: 218 | OsU6 Terminator (SEQ ID NO: 74) |
| 132053 | OsU6 (SEQ ID NO: 72) | SEQ ID NO: 219 | OsU6 Terminator (SEQ ID NO: 74) |
| 132054 | OsU6 (SEQ ID NO: 72) | SEQ ID NO: 220 | OsU6 Terminator (SEQ ID NO: 74) |
| 132164 | OsU6 (SEQ ID NO: 72) | SEQ ID NO: 229 | OsU6 Terminator (SEQ ID NO: 74) |

To facilitate insertion of a hygromycin gene cassette into the rice CAO1 genomic locus, repair donor cassettes were designed with approximately 1,000-base pair homology upstream and downstream of the site of the intended double-strand break to be caused by the action of the Cpf1 or Csm1 enzyme coupled with the gRNA targeting this locus. FIG. 1 provides a schematic view of the CAO1 genomic locus and the homology arms that were used to guide homologous recombination and insertion of the hygromycin gene cassette in the CAO1 locus. The hygromycin gene cassette that was inserted into the rice CAO1 genomic locus included the maize ubiquitin promoter (SEQ ID NO:46) driving the expression of the hygromycin resistance gene (SEQ ID NO:76, encoding SEQ ID NO:77), which was flanked at its 3' end by the Cauliflower Mosaic Virus 35S polyA sequence (SEQ ID NO:54). Table 5 summarizes the repair donor cassette vectors that were constructed for hygromycin insertion in the rice CAO1 genomic locus.

TABLE 5

Rice CAO1 repair donor cassettes for hygromycin resistance gene insertion

| Vector | Repair Donor Cassette |
|---|---|
| 131760 | SEQ ID NO: 75 |
| 131632 | SEQ ID NO: 89 |
| 131633 | SEQ ID NO: 90 |
| 131987 | SEQ ID NO: 221 |

TABLE 5-continued

Rice CAO1 repair donor cassettes for hygromycin resistance gene insertion

| Vector | Repair Donor Cassette |
|---|---|
| 131988 | SEQ ID NO: 222 |
| 131990 | SEQ ID NO: 223 |
| 131991 | SEQ ID NO: 224 |
| 131992 | SEQ ID NO: 225 |
| 131993 | SEQ ID NO: 226 |
| 131994 | SEQ ID NO: 227 |

For introduction of the cpf1 cassette or csm1 cassette, gRNA-containing plasmid, and repair donor cassette into rice cells, particle bombardment was used. For bombardment, 2 mg of 0.6 μm gold particles were weighed out and transferred to sterile 1.5-mL tubes. 500 mL of 100% ethanol was added, and the tubes were sonicated for 10-15 seconds. Following centrifugation, the ethanol was removed. One milliliter of sterile, double-distilled water was then added to the tube containing the gold beads. The bead pellet was briefly vortexed and then was re-formed by centrifugation, after which the water was removed from the tube. In a sterile laminar flow hood, DNA was coated onto the beads. Table 6 shows the amounts of DNA added to the beads. The plasmid containing the Cpf1 cassette or Csm1 cassette, the gRNA-containing plasmid, and the repair donor cassette were added to the beads and sterile, double-distilled water was added to bring the total volume to 50 μL. To this, 20 μL of spermidine (1 M) was added, followed by 50 μL of $CaCl_2$ (2.5 M). The gold particles were allowed to pellet by gravity for several minutes, and were then pelleted by centrifugation. The supernatant liquid was removed, and 800 μL of 100% ethanol was added. Following a brief sonication, the gold particles were allowed to pellet by gravity for 3-5 minutes, then the tube was centrifuged to form a pellet. The supernatant was removed and 30 μL of 100% ethanol was added to the tube. The DNA-coated gold particles were resuspended in this ethanol by vortexing, and 10 μL of the resuspended gold particles were added to each of three macro-carriers (Bio-Rad, Hercules, Calif.). The macro-carriers were allowed to air-dry for 5-10 minutes in the laminar flow hood to allow the ethanol to evaporate.

TABLE 6

Amounts of DNA used for particle bombardment experiments (all amounts are per 2 mg of gold particles)

| | |
|---|---|
| Cpf1 or Csm1 plasmid | 1.5 μg |
| gRNA-containing plasmid | 1.5 μg |
| Repair donor cassette plasmid | 3-15 μg |
| Sterile, double-distilled water | Add to bring total volume to 50 μL |

Rice callus tissue was used for bombardment. The rice callus was maintained on callus induction medium (CIM; 3.99 g/L N6 salts and vitamins, 0.3 g/L casein hydrolysates, 30 g/L sucrose, 2.8 g/L L-proline, 2 mg/L 2,4-D, 8 g/L agar, adjusted to pH 5.8) for 4-7 days at 28° C. in the dark prior to bombardment. Approximately 80-100 callus pieces, each 0.2-0.3 cm in size and totaling 1-1.5 g by weight, were arranged in the center of a Petri dish containing osmotic solid medium (CIM supplemented with 0.4 M sorbitol and 0.4 M mannitol) for a 4-hour osmotic pretreatment prior to particle bombardment. For bombardment, the macro-carriers containing the DNA-coated gold particles were assembled into a macro-carrier holder. The rupture disk (1,100 psi), stopping screen, and macro-carrier holder were assembled according to the manufacturer's instructions. The plate containing the rice callus to be bombarded was placed 6 cm beneath the stopping screen and the callus pieces were bombarded after the vacuum chamber reached 25-28 in. Hg. Following bombardment, the callus was left on osmotic medium for 16-20 hours, then the callus pieces were transferred to selection medium (CIM supplemented with 50 mg/L hygromycin and 100 mg/L timentin). The plates were transferred to an incubator and held at 28° C. in the dark to begin the recovery of transformed cells. Every two weeks, the callus was sub-cultured onto fresh selection medium. Hygromycin-resistant callus pieces began to appear after approximately five to six weeks on selection medium. Individual hygromycin-resistant callus pieces were transferred to new selection plates to allow the cells to divide and grow to produce sufficient tissue to be sampled for molecular analysis. Table 7 summarizes the combinations of DNA vectors that were used for these rice bombardment experiments.

TABLE 7

Summary of rice particle bombardment experiments for hygromycin resistance gene insertion at CAO1 locus

| Experiment | Cpf1 or Csm1 Plasmid | gRNA Plasmid | Repair Donor Plasmid |
|---|---|---|---|
| 1 | 131272 | 131608 | 131760 |
| 2 | 131272 | 131608 | 131632 |
| 3 | 131273 | 131610 | 131632 |
| 4 | 131276 | 131612 | 131632 |
| 5 | 131272 | 131609 | 131633 |
| 6 | 131273 | 131611 | 131633 |
| 7 | 131276 | 131613 | 131633 |
| 13 | 131279 | 131912 | 131632 |
| 14 | 131274 | 131914 | 131632 |
| 15 | 131275 | 131913 | 131632 |
| 31 | 131277 | 132033 | 131632 |
| 32 | 131272 | 131985 | 131987 |
| 33 | 131272 | 131986 | 131988 |
| 43 | 131279 | 132051 | 131633 |
| 44 | 131274 | 132052 | 131633 |
| 45 | 131275 | 132053 | 131633 |
| 46 | 131277 | 132054 | 131633 |
| 53 | 131272 | 131982 | 131992 |
| 54 | 131272 | 131983 | 131993 |
| 55 | 131272 | 131980 | 131990 |
| 56 | 131272 | 131981 | 131991 |
| 57 | 131272 | 131984 | 131994 |
| 58 | 132058 | 131609 | 131633 |
| 59 | 132059 | 131609 | 131633 |
| 66 | 132068 | 131609 | 131633 |
| 67 | 132066 | 131609 | 131633 |
| 68 | 132065 | 131609 | 131633 |
| 69 | 132075 | 131609 | 131633 |
| 70 | 132067 | 131609 | 131633 |
| 71 | 132082 | 131609 | 131633 |
| 75 | 132096 | 131609 | 131633 |
| 76 | 132098 | 131609 | 131633 |
| 78 | 132083 | 131608 | 131632 |
| 79 | 132066 | 131608 | 131632 |
| 80 | 132065 | 131608 | 131632 |
| 81 | 132084 | 131608 | 131632 |
| 85 | 132075 | 131608 | 131632 |
| 86 | 132095 | 131608 | 131632 |
| 87 | 132099 | 131608 | 131632 |
| 88 | 132105 | 131608 | 131632 |
| 89 | 132100 | 131608 | 131632 |
| 90 | 132094 | 131608 | 131632 |
| 91 | 132093 | 131608 | 131632 |
| 92 | 132111 | 131608 | 131632 |
| 93 | 132092 | 131608 | 131632 |
| 94 | 132097 | 131608 | 131632 |
| 95 | 132106 | 131608 | 131632 |
| 96 | 132107 | 131608 | 131632 |
| 97 | 132102 | 131608 | 131632 |

TABLE 7-continued

Summary of rice particle bombardment experiments for hygromycin resistance gene insertion at CAO1 locus

| Experiment | Cpf1 or Csm1 Plasmid | gRNA Plasmid | Repair Donor Plasmid |
|---|---|---|---|
| 98 | 132104 | 131608 | 131632 |
| 99 | 132109 | 132164 | 131632 |
| 100 | 132101 | 132164 | 131632 |
| 101 | 132103 | 132164 | 131632 |
| 102 | 132108 | 132164 | 131632 |
| 104 | 132143 | 132164 | 131632 |
| 105 | 132145 | 132164 | 131632 |
| 106 | 132059 | 131608 | 131632 |
| 107 | 132067 | 131608 | 131632 |
| 108 | 132096 | 131608 | 131632 |
| 109 | 132058 | 131608 | 131632 |
| 118 | 132110 | 131608 | 131632 |
| 119 | 132144 | 131608 | 131632 |

After the individual hygromycin-resistant callus pieces from each experiment were transferred to new plates, they grew to a size that was sufficient for sampling. A small amount of tissue was harvested from each individual piece of hygromycin-resistant rice callus and DNA was extracted from these tissue samples for PCR and DNA sequencing analysis. For those experiments that used repair donor plasmids 131760 or 131632, PCR was performed on these DNA extracts using primers with the sequences of SEQ ID NOs:78 and 79 designed to amplify a region of DNA spanning from the ZmUbi promoter into a region of the rice genome that falls outside of the downstream repair donor arm, as depicted schematically in FIG. 1. For those experiments that used repair donor plasmid 131633, primers with the sequences of SEQ ID NOs:102 and 103 were used to amplify a region of DNA spanning from the CaMV 35S terminator into a region of the rice genome that falls outside of the upstream repair donor arm, as depicted schematically in FIG. 1. These PCR reactions do not produce an amplicon from wild-type rice DNA, nor from the repair donor plasmid, and thus are indicative of an insertion event at the rice CAO1 locus. Table 8 summarizes the number of hygromycin-resistant callus pieces produced from each experiment described in Table 7 as well as the number of PCR-positive callus pieces in which a putative insertion event occurred. The number of callus pieces used for each bombardment experiment was estimated by weight based on a survey of ten plates, with 159±11.1 callus pieces per plate.

TABLE 8

Summary of rice callus bombardment experiments

| Experiment | # Callus Pieces Bombarded (approximate) | # hygromycin-resistant callus pieces | # Events PCR-Positive for Insertion |
|---|---|---|---|
| 01 | 4134 | 290 | 12 |
| 02 | 795 | 20 | 0 |
| 03 | 1749 | 39 | 1 |
| 04 | 954 | 24 | 0 |
| 05 | 2067 | 46 | 3 |
| 06 | 1908 | 57 | 5 |
| 07 | 3339 | 49 | 3 |
| 13 | 3339 | 90 | 0 |
| 14 | 3180 | 81 | 0 |
| 15 | 4134 | 138 | 0 |
| 31 | 2067 | 55 | 0 |
| 43 | 1908 | 68 | 0 |
| 44 | 2544 | 117 | 0 |
| 45 | 1908 | 143 | 0 |
| 46 | 1908 | 192 | 3 |
| 58 | 1908 | 192 | 1 |
| 59 | 1431 | 192 | 1 |
| 66 | 1431 | 192 | 0 |
| 67 | 477 | 192 | 0 |
| 68 | 477 | 192 | 0 |
| 70 | 1431 | 192 | 1 |
| 71 | 1431 | 192 | 0 |
| 75 | 1431 | 192 | 1 |
| 76 | 1431 | 192 | 0 |
| 78 | 1908 | 192 | 0 |
| 79 | 954 | 192 | 0 |
| 80 | 954 | 160 | 0 |
| 81 | 1431 | 192 | 0 |
| 85 | 1113 | 96 | 0 |
| 86 | 1113 | 133 | 0 |
| 87 | 1113 | 155 | 0 |
| 88 | 1272 | 192 | 0 |
| 89 | 954 | 192 | 0 |
| 90 | 954 | 192 | 0 |
| 91 | 954 | 192 | 0 |
| 92 | 954 | 192 | 0 |
| 93 | 954 | 192 | 0 |
| 94 | 954 | 192 | 0 |
| 95 | 954 | 192 | 0 |
| 97 | 954 | 192 | 0 |
| 98 | 1431 | 192 | 0 |
| 99 | 1272 | 192 | 0 |
| 100 | 1272 | 192 | 0 |
| 101 | 1272 | 192 | 0 |
| 102 | 1272 | 192 | 0 |
| 104 | 1272 | 192 | 0 |
| 105 | 1113 | 192 | 0 |
| 106 | 1113 | 192 | 0 |
| 107 | 1113 | 192 | 0 |
| 108 | 1272 | 96 | 0 |
| 109 | 1272 | 96 | 0 |
| 118 | 954 | 96 | 0 |
| 119 | 954 | 96 | 0 |

For the PCR-positive callus pieces listed in Table 8, additional PCR analysis was done to amplify across the junctions between both homology arms and the rice genome. Primers with the sequence of SEQ ID NOs:96 and 97 were used to amplify the upstream region for those experiments that used repair donor plasmids 131760 or 131632. The location of these primer binding sites are shown schematically in FIG. 1.

Figure 2:
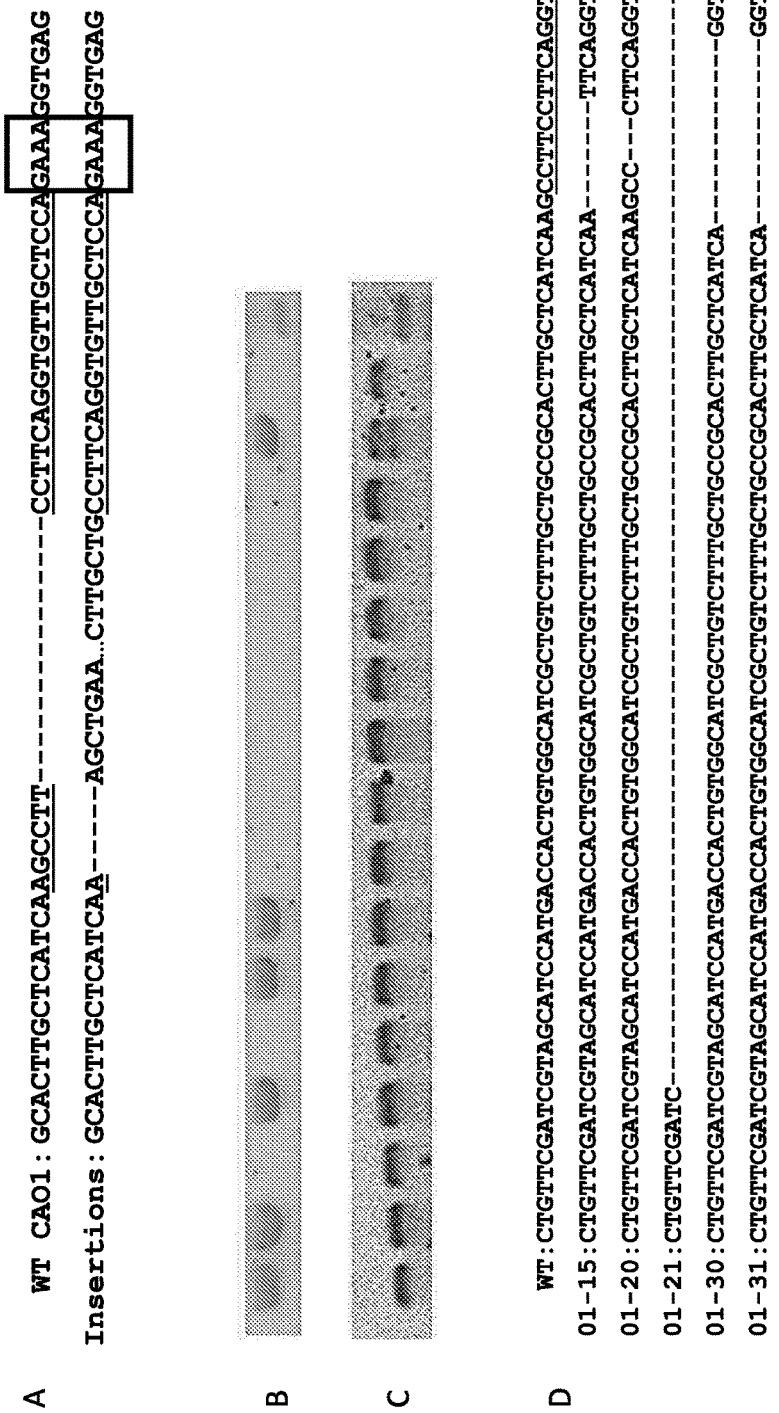
FIGS. 2A, 2B, 2C, and 2D show sequence data obtained from rice calli generated during Experiment 1.

Sanger sequencing of the PCR amplicons produced using the primer pairs described above to amplify the downstream region of the insertion event showed that the expected sequence was present in the transformed rice callus, confirming insertion of the hygromycin gene cassette at the expected genomic locus mediated by the double-stranded break produced by the Cpf1 or Csm1 enzyme. Sanger sequencing of the PCR amplicons produced using the primer pairs described above to amplify the upstream region of the insertion events also showed the expected sequence was present in the transformed rice callus, further confirming insertion of the hygromycin gene cassette at the expected genomic locus mediated by the double-stranded break produced by the Cpf1 or Csm1 enzyme. Importantly, a deletion of five base pairs (GCCTT) from the rice genomic sequence was predicted to occur at the upstream insertion site following Cpf1-mediated DSB formation, and this deletion was confirmed from the sequencing data, thus further verifying that the observed insertion events were mediated by the action of Cpf1. FIG. 2A shows an alignment summarizing the sequencing data that confirmed the insertion events at the rice CAO1 locus targeted in Experiment 1 (see Table 7).

Sequencing of the PCR products used to confirm the presence of a targeted insertion at the rice CAO1 locus as targeted in Experiments 5 and 7 (see Table 7) was performed. Primers with the sequence of SEQ ID NOs:104 and 105 were used to amplify the downstream region of these insertion events. These PCR products were sequenced and the expected sequences were observed for insertion events mediated by DSB production by FnCpf1 (Experiment 5) and MbCpf1 (Experiment 7). The hph cassette was inserted in the CAO1 locus at the targeted site with no base changes in the downstream arm.

Figure 4:
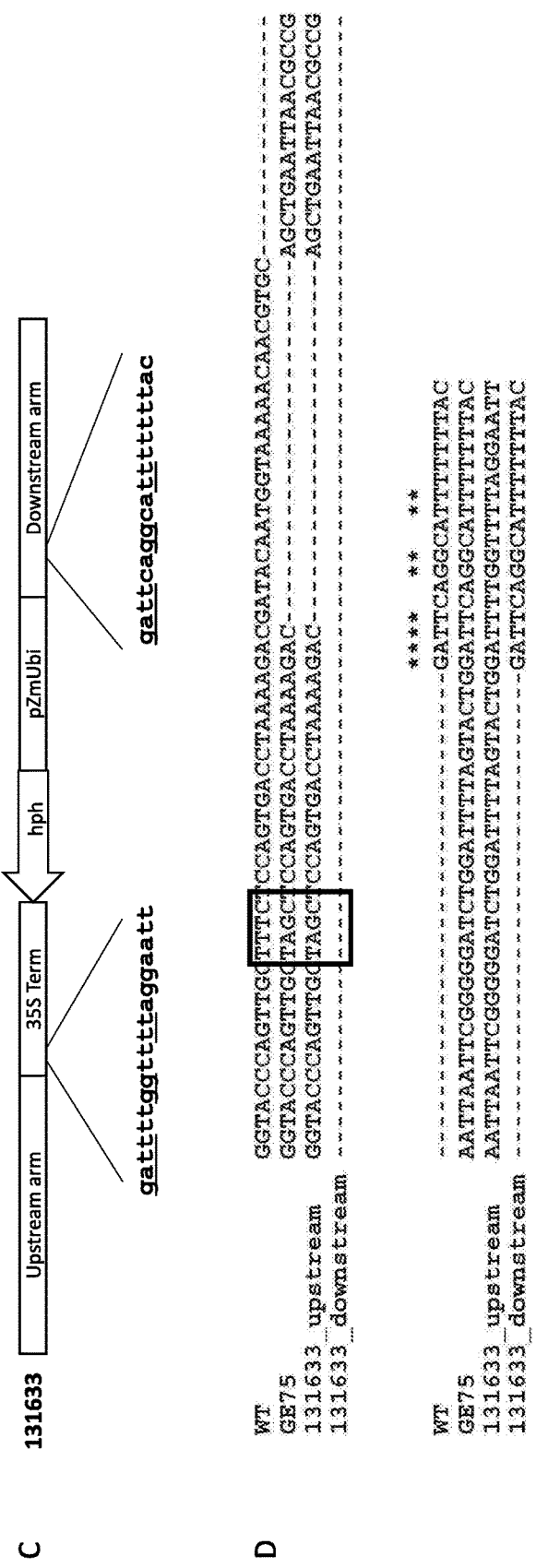
FIGS. 4A, 4B, 4C, and 4D show an overview of the unexpected recombination events recovered from Experiments 70 and 75.

Experiment 70 (Table 7) resulted in an insertion of a portion of the 35S terminator present in plasmid 131633 at the intended insertion site in the rice CAO1 genomic locus rather than an insertion of the entire hph cassette. Sequence analysis showed that the 35S terminator contained an eleven base pair region that shared ten bases with the downstream arm (FIG. 4A). It appears that this region in the 35S terminator mediated an unintended homologous recombination event with the downstream arm in rice callus piece #70-15, while the upstream arm in plasmid 131633 mediated the intended recombination event between this plasmid and the sequence upstream of the locus in the rice CAO1 gene targeted by the guide RNA and Cpf1 enzyme, resulting in the insertion sequence shown in FIG. 4B. The resulting insertion led to a 179 base pair deletion and a 133 base pair insertion at the rice CAO1 locus. While the insertion event uncovered in experiment 70 included only a portion of the 35S terminator rather than the full hph cassette that was intended for insertion, the event recovered was at the intended site in the CAO1 locus targeted by the *Prevotella bryantii* Cpf1 enzyme (SEQ ID NO:138, encoded by SEQ ID NO:179), indicating that this Cpf1 enzyme was effective at producing the intended DSB in the CAO1 genomic locus.

Experiment 75 (Table 7) resulted in an insertion of a portion of the 35S terminator present in plasmid 131633 at the intended insertion site in the rice CAO1 genomic locus rather than an insertion of the entire hph cassette. Sequence analysis showed that the 35S terminator contained a twelve base pair region that shared eight bases with the downstream arm (FIG. 4C). It appears that this region in the 35S terminator mediated an unintended homologous recombination event with the downstream arm in rice callus piece #75-46, while the upstream arm in plasmid 131633 mediated the intended recombination event between this plasmid and the sequence upstream of the locus in the rice CAO1 gene targeted by the guide RNA and Cpf1 enzyme, resulting in the insertion sequence shown in FIG. 4D. The resulting insertion led to a 47 base pair deletion and a 24 base pair insertion at the rice CAO1 locus. While the insertion event uncovered in experiment 75 included only a portion of the 35S terminator rather than the full hph cassette that was intended for insertion, the event recovered was at the intended site in the CAO1 locus targeted by the *Proteocatella sphenisci* Cpf1 enzyme (SEQ ID NO:142, encoded by SEQ ID NO:191), indicating that this Cpf1 enzyme was effective at producing the intended DSB in the CAO1 genomic locus.

Experiment 46 (Table 7) resulted in an insertion of at the intended insertion site in the rice CAO1 genomic locus, mediated by the Lachnospiraceae bacterium ND2006 Cpf1 enzyme (SEQ ID NO:18, encoded by SEQ ID NO:19). PCR analysis of the region of the intended insertion site at the CAO1 locus resulted in amplification of a band that is diagnostic of an insertion in callus piece #46-161. This genomic region was subjected to sequence analysis to confirm the presence of the intended DNA insertion at the rice CAO1 locus. FIG. 5 shows the results of this sequence analysis, with the expected insertion from the 131633 vector present in the rice DNA at the expected site. The mutated PAM site (TTTC>TAGC) present in the 131633 vector was also detected in the rice DNA from callus piece #46-161, further supporting HDR-mediated insertion of the 131633 vector insert at the rice CAO1 locus as mediated by the site-specific DSB induction by the Lachnospiraceae bacterium ND2006 Cpf1 enzyme.

Experiment 58 (Table 7) resulted in an insertion of at the intended insertion site in the rice CAO1 genomic locus, mediated by the *Anaerovibrio* sp. RM50 Cpf1 enzyme (SEQ ID NO:143, encoded by SEQ ID NO:176). PCR analysis of the region of the intended insertion site at the CAO1 locus resulted in amplification of a band that is diagnostic of an insertion in callus piece #58-169. This genomic region is subjected to sequence analysis to confirm the presence of the intended DNA insertion at the rice CAO1 locus.

Example 11—Cpf1-Mediated Genomic DNA Modification at the Rice CAO1 Locus

Rice callus was bombarded as described above with gold beads that were coated with a cpf1 vector and gRNA vector. Rice callus that was bombarded as described for experiment 01 (Table 7) was left on osmotic medium for 16-20 hours following bombardment, then the callus pieces were transferred to selection medium (CIM supplemented with 50 mg/L hygromycin and 100 mg/L timentin). The plates were transferred to an incubator and held at 28° C. in the dark to begin the recovery of transformed cells. Every two weeks, the callus was sub-cultured onto fresh selection medium. Hygromycin-resistant callus pieces began to appear after approximately five to six weeks on selection medium. Individual hygromycin-resistant callus pieces were transferred to new selection plates to allow the cells to divide and grow to produce sufficient tissue to be sampled for molecular analysis.

DNA was extracted from sixteen hygromycin-resistant callus pieces produced in Experiment 01 (Table 7) and PCR was performed using primers with the sequences of SEQ ID NOs:100 and 101 to test for the presence of the cpf1 cassette. This PCR reaction showed that DNA extracted from callus pieces numbered 1, 2, 4, 6, 7, and 15 produced the expected 853 base pair amplicon consistent with insertion of the cpf1 cassette in the rice genome (FIG. 2B). PCR was also performed with DNA extracted from these hygromycin-resistant rice callus pieces using primers with the sequences of SEQ ID NOs:98 and 99 to amplify a region of the rice CAO1 genomic locus that was targeted by the gRNA in vector 131608. This PCR reaction produced a 595-base pair amplicon when using wild-type rice DNA as the template. Following the PCR reaction with SEQ ID NOs:98 and 99 as the primers, a T7 endonuclease assay was performed with the resulting PCR product to test for small insertions and/or deletions at this locus. DNA from callus piece number 15 showed a band pattern consistent with a small insertion or deletion (FIG. 2C). The PCR products produced from the reaction using primers with SEQ ID NOs:98 and 99 was cloned into *E. coli* cells using the pGEM® system (Promega, Madison, Wis.) according to the manufacturer's instructions. DNA was extracted from eight single *E. coli* colonies for sequencing. Five of the eight colonies showed the same seven base pair deletion at the predicted Cpf1-mediated double-strand break site in the CAO1 locus (FIG. 2D).

Without being limited by theory, a likely explanation for this deletion is that the rice cell DNA repair machinery produced the deletion following repair of the double-stranded break caused by FnCpf1 at the CAO1 locus.

Experiment 01 (Table 7) was repeated with additional pieces of rice callus to confirm the reproducibility of the results obtained initially. The repeat of Experiment 01 resulted in the identification of four additional callus pieces that appeared to be positive for indel production based on T7EI assay results. DNA was extracted from these callus pieces for sequence analysis. PCR was performed to amplify the region of the rice genome surrounding the targeted site in the CAO1 gene and Sanger sequencing was performed. The sequencing results confirmed the T7EI assay results. FIG. 2D shows the resulting sequence data. These four callus pieces showed varying deletion sizes ranging from a three base pair to a seventy-five base pair deletion, all located at the expected site targeted by FnCpf1 (SEQ ID NO:3, encoded by SEQ ID NO:5).

Figure 3:
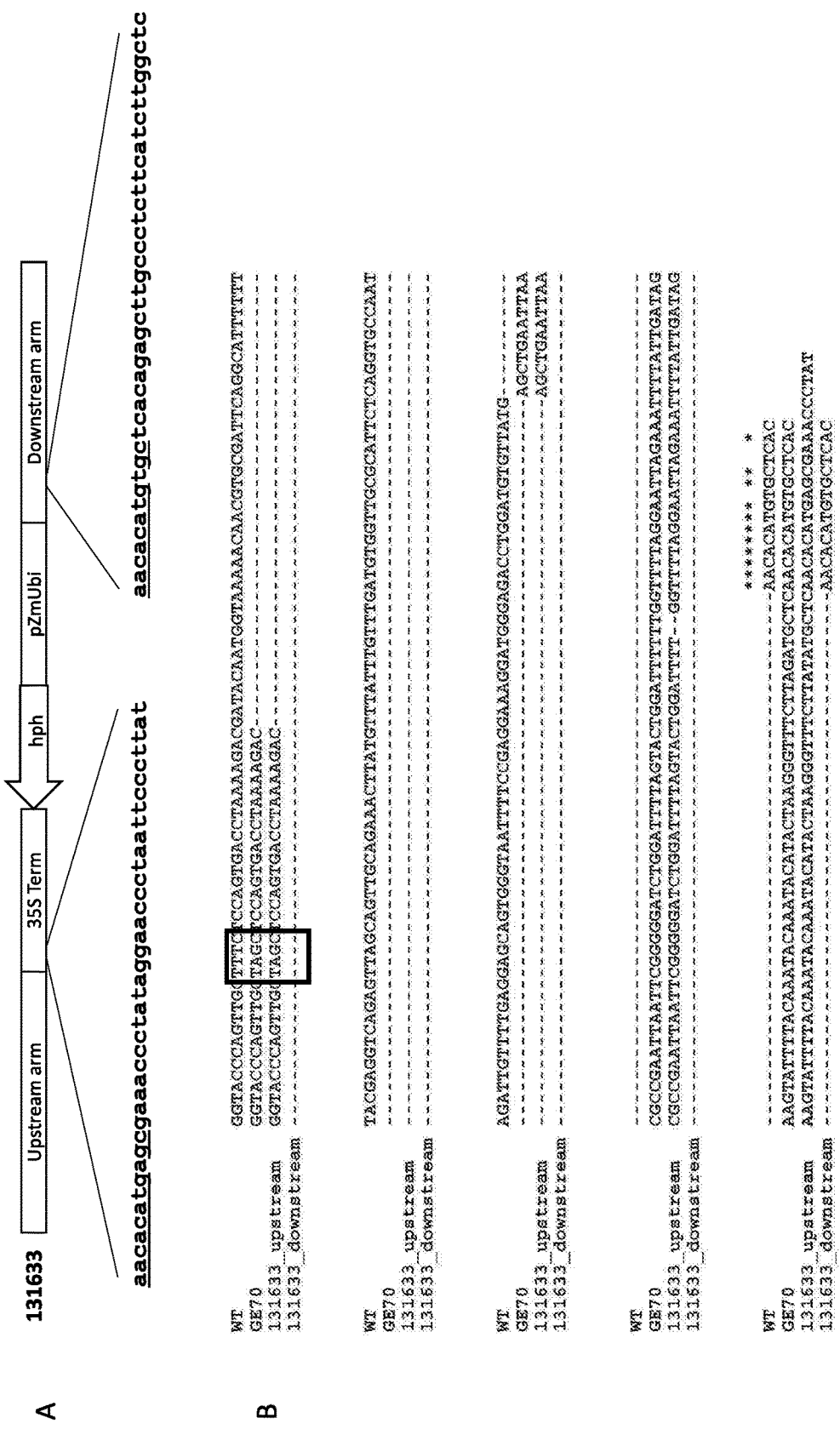
FIGS. 3A and 3B show sequence data from Experiments 31, 46, 80, 81, 91, and 93, verifying Cpf1-mediated and Csm1-mediated indels in the rice CAO1 genomic locus.

Experiments 31 and 46 (Table 7) tested the ability of LbCpf1 (SEQ ID NO:18, encoded by SEQ ID NO:19) to effect DSBs at two different locations in the rice CAO1 locus. Experiment 31 used plasmid 132033 as the gRNA source, while experiment 46 used plasmid 132054 as the gRNA source. Following bombardment of rice callus with the plasmids used for these experiments, DNA was extracted from hygromycin-resistant rice callus pieces and subjected to T7EI assays. Following PCR amplification of the rice CAO1 genomic locus, T7EI assays identified one callus piece from experiment 31 and five callus pieces from experiment 46 that appeared to contain indels at the expected site. PCR products from these rice callus pieces were analyzed by Sanger sequencing to identify the sequence(s) present at the CAO1 locus in these callus pieces. FIG. 3 shows the results of the Sanger sequencing analyses, confirming the presence of indels at the expected locations in the rice CAO1 locus. FIG. 3A shows the results from Experiment 31 and FIG. 3B shows the results from Experiment 46. As FIG. 3A shows, callus piece 31-21 showed a deletion of fifty-six base pairs along with a ten base pair insertion. The calli from experiment 46 (data presented in FIG. 3B) showed deletions with sizes ranging from three to fifteen base pairs. It should be noted that callus pieces 46-38 and 46-77 showed two different indels, indicating that multiple indel production events had occurred in independent cells within these callus pieces. All of the indels from these experiments were located at the predicted site in the CAO1 locus targeted by the respective guide RNA, indicating faithful production of DSBs at this site by the LbCpf1 enzyme.

Experiment 80 (Table 7) tested the ability of the *Moraxella caprae* Cpf1 enzyme (SEQ ID NO:133, encoded by SEQ ID NO:175) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified one callus piece from the experiment that contained an indel at the expected site. A PCR product from this rice callus piece was analyzed by Sanger sequencing to identify the sequence present at the CAO1 locus in this callus piece. FIG. 3A shows the results of these sequencing assays, with an eight base pair deletion present in callus piece #80-33 at the predicted site in the CAO1 locus targeted by the respective guide RNA, indicating faithful DSB production at this site by the *Moraxella caprae* Cpf1 enzyme.

Experiment 91 (Table 7) tested the ability of the Lachnospiraceae bacterium COE1 Cpf1 enzyme (SEQ ID NO:125, encoded by SEQ ID NO:189) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified one callus piece from the experiment that contained an indel at the expected site. A PCR product from this rice callus piece was analyzed by Sanger sequencing to identify the sequence present at the CAO1 locus in this callus piece. FIG. 3A shows the results of these sequencing assays, with a nine base pair deletion present in callus piece #91-4 at the predicted site in the CAO1 locus targeted by the respective guide RNA, indicating faithful DSB production at this site by the Lachnospiraceae bacterium COE1 Cpf1 enzyme.

Experiment 119 (Table 7) tested the ability of the *Eubacterium coprostanoligenes* Cpf1 enzyme (SEQ ID NO:173, encoded by SEQ ID NO:205) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified two callus pieces from the experiment that contained an indel at the expected site. A PCR product from these rice callus pieces were analyzed by Sanger sequencing to identify the sequence present at the CAO1 locus in these calli. FIG. 3A shows the results of these sequencing assays, with an identical eight base pair deletion present in both callus pieces #119-4 and #119-11 at the predicted site in the CAO1 locus targeted by the respective guide RNA, indicating faithful DSB production at this site by the *Eubacterium coprostanoligenes* Cpf1 enzyme.

Example 12—Regeneration of Rice Plants with an Insertion at the CAO1 Locus

Rice callus transformed with an hph cassette targeted to the CAO1 locus by an FnCpf1-mediated DSB in Experiment 1 (see Tables 7 and 8) was cultured on tissue culture medium to produce shoots. These shoots were subsequently transferred to rooting medium, and the rooted plants were transferred to soil for cultivation in a greenhouse. The rooted plants appeared to be phenotypically normal in soil. DNA was extracted from the rooted plants for PCR analysis. PCR amplification of the upstream and downstream arms confirmed that the hph cassette was present in the rice CAO1 genomic locus.

T0-generation rice plants generated in Experiment 1 with the hph cassette insertion at the CAO1 locus were cultivated and self-pollinated to produce T1-generation seed. This seed was planted and the resulting T1-generation plants were genotyped to identify homozygous, hemizygous, and null plants. The T1 plants segregated as expected, with approximately 25% of the T1 plants being hemizygous for the hph insertion, 25% being null segregants, and 50% being heterozygous. Homozygous plants were observed phenotypically, with the expected yellow leaf phenotype associated with knockout of the CAO1 gene (Lee et al. (2005) *Plant Mol Biol* 57:805-818).

T0-generation plants were regenerated from GE0046 callus number 33, 40, 62, and 90, that had shown positive results for indels via T7EI assays and (for callus piece #90) sequence verification (FIG. 3B). Regenerated plants derived from callus pieces 46-33, 40, 62, and 90 were positive for the presence of an indel at the CAO1 locus based on T7EI assays using DNA extracted from the regenerated plant tissue. Plants were also regenerated from GE0046 callus pieces 46-96 and 46-161, which had previously been shown to have an insertion of the hygromycin marker at the CAO1 locus. Plants derived from callus pieces 46-96 and 46-161 were all positive for the insertion as detected by a PCR screen. Sequence data obtained from DNA extracted from two plants regenerated from callus piece #46-90 showed the same eight base pair deletion detected in the callus (FIG. 3B), indicating that this deletion was stable through the regeneration process. Sequence data obtained from DNA extracted from plants derived from callus pieces #46-40 and from #46-62 showed 8-, 9-, 10, and 11-base pair deletions (data not shown).

Example 13—Identification of a Putative New Class of Cpf1-Like Proteins

Examination of phylogenetic trees of putative Cpf1 proteins (Zetsche et al. (2015) *Cell* 163: 759-771 and data not shown), along with sequence analyses of Cpf1 proteins and Cpf1-like proteins identified through BLAST searches, uncovered a small group of proteins that appeared to be related to Cpf1 proteins, but with significantly altered sequences relative to known Cpf1 proteins. As two of these proteins are found in *Smithella* sp. SCADC and in Microgenomates, this putative new class of proteins has been named Csm1 (CRISPR-associated proteins from *Smithella* and Microgenomates). Like Cpf1 proteins, these Csm1 proteins comprise RuvCI, RuvCII, and RuvCIII domains, but importantly the amino acid sequences of these domains are often quite divergent as compared with those found in Cpf1 protein amino acid sequences, particularly for the RuvCIII domain. Additionally, the RuvCI-RuvCII and RuvCII-RuvCIII spacing is significantly altered in Csm1 proteins relative to Cpf1 proteins.

Alignment of the *Smithella* sp. SCADC Csm1 protein (SmCsm1; SEQ ID NO:160) with known Cpf1 proteins using the BLASTP algorithm default parameters (blast.ncbi.nlm.nih.gov/Blast.cgi) showed very little apparent sequence identity between these proteins. It was particularly apparent that while the RuvCI domain in the SmCsm1 protein appeared to be present and well-aligned with the corresponding sequences in Cpf1 proteins, the RuvCII and RuvCIII regions, well-conserved in Cpf1 proteins (Shmakov et al. (2016) *Mol Cell* 60:385-397), did not initially appear to be present in the putative Csm1 protein. Additional analyses using HHPred (toolkit.tuebingen.mpg.de/hhpred; Söding et al. (2006) *Nucleic Acids Res* 34:W374-W378) uncovered putative RuvCII and RuvCIII domains in this SmCsm1 protein. Table 9 shows the putative RuvCII domains in several Cpf1 and putative Csm1 proteins, and a representative C2c1 protein, along with the amino acid residue numbers in each sequence listing corresponding to the RuvCII sequence listed. The putative active residue is underlined for each protein listed.

TABLE 9

RuvCII sequences from Cpf1 and Csm1 proteins

| Protein | RuvCII sequence | Amino Acid Residue Numbers |
|---|---|---|
| AsCpf1 (SEQ ID NO: 6) | Q--AVVVL<u>E</u>NLNFGF | 987-999 |
| LbCpf1 (SEQ ID NO: 18) | D--AVIAL<u>E</u>DLNSGF | 919-931 |
| SSCSM1 (SEQ ID NO: 147) | K--AYISL<u>E</u>DLSRAY | 1057-1069 |
| SMCSM1 (SEQ ID NO: 160) | R--GIISI<u>E</u>DLKQTK | 920-932 |
| ObCsm (SEQ ID NO: 230) | FPETIVAL<u>E</u>NLAKGT | 931-945 |
| Sm2Csm1 (SEQ ID NO: 159) | R--GIISI<u>E</u>DLKQTK | 920-932 |
| MbCSM1 (SEQ ID NO: 134) | Q--GVIAL<u>E</u>NLDTVR | 916-928 |
| AacC2c1 (SEQ ID NO: 237) | PPCQLILL<u>E</u>ELS-EY | 840-853 |

Table 10 shows the putative RuvCIII domains in several Cpf1 and putative Csm1 proteins along with a representative C2c1 protein, along with the amino acid residue numbers in each sequence listing corresponding to the RuvCIII sequence listed. The putative active residue is underlined for each protein listed.

TABLE 10

RuvCIII sequences from Cpf1 and Csm1 proteins

| Protein | RuvCIII sequence | Amino Acid Numbers |
|---|---|---|
| AsCpf1 (SEQ ID NO: 6) | WPM----------DADANGAYHIALK | 1258-1273 |
| LbCpf1 (SEQ ID NO: 18) | LPK----------NADANGAYNIARK | 1175-1190 |
| SSCSM1 (SEQ ID NO: 147) | RENNIHYIH-----NGDDNGAYHIALK | 1202-1223 |
| SmCsm1 (SEQ ID NO: 160) | FDTRNDLKGFEGLNDPDKVAAFNIAKR | 1029-1055 |
| ObCsm1 (SEQ ID NO: 230) | SLN----------SPDTVAAYNVARK | 1048-1063 |
| Sm2Csm1 (SEQ ID NO: 159) | SLD----------SNDKVAAFNIAKR | 1061-1076 |
| MbCsm1 (SEQ ID NO: 134) | NLH----------NSDDVAAFNIAKR | 1035-1050 |
| AacC2c1 (SEQ ID NO: 237) | HQI----------HADLNAAQNLQQR | 972-987 |

As Tables 9 and 10 show, the RuvCII and RuvCIII domains identified by HHPred for the putative Csm1 proteins (SEQ ID NOs:134, 147, 159, 160, and 230) are significantly divergent from those found in Cpf1 proteins (representative sequences SEQ ID NOs:6 and 18 shown above). Of particular note, the ANGAY motif following the active residue in the RuvCIII domain is extremely well-conserved among Cpf1 proteins (Shmakov et al. (2016) Mol Cell 60:385-397 and data not shown), but is absent or altered in most of these Csm1 proteins. Analysis of the RuvCII and RuvCIII domains in Csm1, Cpf1, and C2c1 proteins (Shmakov et al. (2016) Mol Cell 60:385-397) suggests that Csm1 proteins appear to be intermediate between Cpf1 and C2c1 proteins, as the Csm1 RuvCII sequences are similar to those found in Cpf1 proteins, while Csm1 RuvCIII sequences are similar to those found in C2c1 proteins. The RuvCIII domains of Csm1 proteins mostly contain a DXXAA motif that is conserved in the C2c1 protein sequence.

While Csm1 proteins share some sequence similarity with C2c1 proteins, their genomic context suggests that Csm1 proteins function in many ways like Cpf1 proteins. Specifically, C2c1 proteins require both a crRNA and a tracrRNA, with the tracrRNA being partially complementary to the crRNA sequence. The genomic locus comprising the Csm1-encoding ORF from Smithella sp. SCADC (SEQ ID NO:238) includes a CRISPR array with Cpf1-like direct repeats, preceded by a Csm1 ORF, Cas4 ORF, Cas1 ORF, and Cas2 ORF. This is consistent with the genomic organization found in Cpf1-encoding genomes (Shmakov et al. (2017) Nat Rev Microbiol doi:10.1038/nrmicro.2016.184). In contrast, C2c1 genomic organization tends to contain a fused Cas1/Cas4 ORF. Further, C2c1-containing genomic loci tend to encode both a crRNA array and a tracrRNA with partial complementarity to the crRNA direct repeat. Examination of the Smithella sp. SCADC genomic locus containing the Csm1-encoding ORF and associated crRNA sequences did not uncover any tracrRNA-like sequences, strongly suggesting that Csm1 does not require a tracrRNA to produce double-stranded breaks.

Recently, a new class of nucleases termed CasX proteins was described (Burstein et al. (2016) Nature http://dx.doi.org10.1038/nature20159). The CasX protein from Deltaproteobacteria (SEQ ID NO:239) was described as a ~980-amino acid protein that was found in a genomic region that included Cas1, Cas4, and Cas2 protein-coding regions as well as a CRISPR repeat region and a tracrRNA. The report describing CasX showed conclusively that this tracrRNA was required for endonuclease function, in sharp contrast with Csm1 proteins that do not require a tracrRNA. BLASTP alignments of SmCsm1 (SEQ ID NO:160) and Deltaproteobacterial CasX (SEQ ID NO:239) showed a very poor alignment (data not shown). HHPred analysis of this CasX protein was used to identify putative RuvCI, RuvCII, and RuvCIII domains and their respective active site residues.

In addition to the altered amino acid sequences of the putative RuvCII and RuvCIII domains in Csm1 proteins relative to Cpf1 proteins, the protein organization is significantly altered such that the spacing between these domains is significantly different between Csm1 and Cpf1 proteins. Table 11 shows a comparison of the spacing between the active residues in RuvC subdomains in known Cpf1 proteins (AsCpf1 and LbCpf1; SEQ ID NOs:6 and 18) as compared with the spacing in these putative Csm1 proteins (SEQ ID NOs: 134, 147, 159, 160, and 230), the Deltaproteobacterial CasX protein (SEQ ID NO:239), and a representative C2c1 protein (SEQ ID NO:237). The data in Table 11 shows clearly that Cpf1, CasX, C2c1, and Csm1 proteins have a characteristic RuvC domain spacing, with the CasX RuvCI-RuvCII spacing resembling Cpf1 and the RuvCII-RuvCIII spacing resembling Csm1/C2c1 spacing. The spacing of the RuvCI, RuvCII, and RuvCIII domains in C2c1 and Csm1 proteins is similar, but the divergent RuvCIII sequences and the lack of a tracrRNA in Csm1 systems supports the classification of Csm1 nucleases as separate from C2c1 nucleases.

TABLE 11

Comparison of RuvC subdomain spacing

| Protein | RuvCI-RuvCII spacing (# amino acids) | RuvCII-RuvCIII spacing (# amino acids) |
|---|---|---|
| AsCpf1 (SEQ ID NO: 6) | 84 | 269 |
| LbCpf1 (SEQ ID NO: 18) | 92 | 254 |
| CasX (SEQ ID NO: 239) | 97 | 166 |
| SmCsm1 (SEQ ID NO: 160) | 220 | 122 |
| ObCsm1 (SEQ ID NO: 230) | 211 | 113 |
| Sm2Csm1 (SEQ ID NO: 159) | 224 | 139 |
| MbCsm1 (SEQ ID NO: 134) | 225 | 117 |
| SsCsm1 (SEQ ID NO: 147) | 214 | 149 |
| AacC2c1 (SEQ ID NO: 237) | 278 | 129 |

Along with the divergent RuvCII and RuvCIII amino acid sequences and altered spacing of these domains in Csm1 proteins relative to Cpf1 proteins, it should be noted that in many cases, HHPred analyses did not find any Csm1 sequence corresponding to the amino acid residues corresponding to D1225 in FnCpf1 (SEQ ID NO:3) (D1234 in AsCpf1 (SEQ ID NO:6) and D1148 in LbCpf1 (SEQ ID NO:18)). Mutation analysis of the FnCpf1 D1225 residue showed that mutating this residue very significantly reduced the catalytic activity of this nuclease (Zetsche et al. (2015) Cell 163: 759-771), suggesting that the enzymatic function of this residue is very important for Cpf1 enzymes.

In addition to the altered amino acid sequence of the putative RuvC domains in Csm1 proteins relative to Cpf1 proteins, HHPred analyses with Csm1 proteins show no matches with Cpf1 proteins in their N-terminus, in contrast with HHPred analyses based on known Cpf1 proteins. An HHPred analysis with the FnCpf1 amino acid sequence (SEQ ID NO:3) resulted in only two matches, to AsCpf1 (SEQ ID NO:6) and LbCpf1 (SEQ ID NO:18) with 100% probability and covering the entirety of the FnCpf1 amino acid sequence. In contrast, an HHPred analysis with SmCsm1 (SEQ ID NO:160) only finds matches with Cpf1 proteins covering the regions from amino acids 391-1017 and 1003-1064 in SmCsm1. Amino acids 1003-1030 find matches with a variety of proteins including a probable lysine biosynthesis protein, an amino acid carrier protein, a transcription initiation factor, 50S and 30S ribosomal proteins, and DNA-directed RNA polymerases. No matches for the first 390 amino acids of Csm1 are found in this HHPred analysis. Similar HHPred analyses with additional Csm1 proteins (SEQ ID NOs:134, 147, 159, 160, and 230) also failed to find any match for the N-terminal portions of these Csm1 proteins, further supporting the conclusion that these proteins share some similarity with Cpf1 proteins but are not bona fide Cpf1 proteins themselves.

Example 14—Csm1 Functional Characterization

Given the divergent nature of Csm1 proteins relative to Cpf1 proteins, we sought to confirm that these proteins were capable of producing DSBs in vivo. While the amino acid sequences of the Csm1 proteins are quite divergent relative to Cpf1 proteins, genomic analyses of the organisms that are the source of these Csm1 proteins uncovered CRISPR arrays (data not shown), suggesting that these proteins could in fact be functional.

Experiment 81 (Table 7) tested the ability of a Smithella sp. SCADC Csm1 enzyme (SEQ ID NO:160, encoded by SEQ ID NO:185) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified three callus pieces from the experiment that contained an indel at the expected site. PCR products from these rice callus pieces were analyzed by Sanger sequencing to identify the sequence present at the CAO1 locus in this calli. FIG. 3A shows the results of these sequencing assays, with an eight base pair deletion present in callus piece #81-46, an identical eight base pair deletion present in callus piece #81-30, and a twelve base pair deletion present in callus piece #81-9 at the predicted site in the CAO1 locus targeted by the respective guide RNA, indicating faithful DSB production at this site by the Smithella sp. SCADC Csm1 enzyme.

Experiment 93 (Table 7) tested the ability of a Sulfuricurvum sp. Csm1 enzyme (SEQ ID NO:147, encoded by SEQ ID NO:186) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified one callus piece from the experiment that contained an indel at the expected site. A PCR product from rice callus piece #93-47 was analyzed by Sanger sequencing to identify the sequence present at the CAO1 locus in this callus piece. FIG. 3A shows the results of these sequencing assays, with a forty-two base pair deletion present in callus piece #93-47 at the predicted site in the CAO1 locus targeted by the respective guide RNA, indicating faithful DSB production at this site by the Sulfuricurvum sp. Csm1 enzyme.

Experiment 97 (Table 7) tested the ability of a Microgenomates (Roizmanbacteria) bacterium Csm1 enzyme (SEQ ID NO:134, encoded by SEQ ID NO:193) to effect DSBs at the rice CAO1 locus. Following bombardment of rice callus with the plasmids used for this experiment, DNA was extracted from hygromycin-resistant rice callus pieces and subjected to T7EI assays. Following PCR amplification of the rice CAO1 genomic locus, T7EI assays identified three callus piece from the experiment that contained an indel at the expected site. Callus pieces #97-112, 97-130, and 97-141 showed a banding pattern in the T7EI experiment analysis consistent with faithful DSB production at this site by the Microgenomates (Roizmanbacteria) bacterium Csm1 enzyme. DNA extracted from callus pieces #97-112 and #97-141 were subjected to sequence analysis (FIG. 3A). This sequence analysis showed an identical eight base pair deletion present in both of these calli, indicating faithful DSB production at this site by the Microgenomates (Roizmanbacteria) bacterium Csm1 enzyme.

SEQUENCE LISTING (239 sequences)

SEQ ID NO: 1 - protein, 9 aa, Simian Virus 40
  Nuclear_Localization_Signal (1)..(9)
MAPKKKRKV

SEQ ID NO: 2 - DNA, 27 bp, Simian Virus 40
  Nuclear_Localization_Signal (1)..(27)
atggccccaaagaagaaacggaaggtt

SEQ ID NO: 3 - protein, 1300 aa, Francisella tularensis subsp. novicida U112
  cpf1 (1)..(1300)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 4 - DNA, 3903 bp, Francisella tularensis subsp. novicida U112
  cpf1 (1)..(3900)
  cpf1 (1)..(3903)
atgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaa

SEQ ID NO: 5 - DNA, 3903 bp, Francisella tularensis subsp. novicida U112
  cpf1 (1)..(3903)
atgtcgatataccaggaattcgtcaacaagtattctctgtcgaaaactctgcggtttgagctgatccctcaggggaagacccttgaaaacatcaaggcgcggggcctcatcctggatgacgaaaagcgcgcgaaggattataaaaaggccaagcagattatagataaataccatcaattcttcattgaggaaatcctctcatcagtttgcatatcggaagacctgttgcaaaactattccgatgtttacttcaagctgaaaaaaagcgacgatgacaatctgcaaaaagacttcaagtctgctaaagatacaatcaagaagcagatctctgaatacatcaaagactcggagaagttcaaaaatctgtttaatcagaatttgatcgacgccaagaagggccaggagtccgacctcatcctttggttgaagcagagcaaggacaatggcatcgaacttttcaaggccaatagcgatattaccgatatcgacgaggcgctcgagattattaagagcttcaagggttggacaacgtacttcaaaggattccacgagaataggaagaacgtctactcgtcaaacgacataccgacatctatcatttaccgcatcgtcgacgacaatttgcctaagttcctcgagaacaaggccaagtatgaatcgcttaaggacaaagctcctgaggcaattaactacgaacagattaaaaaggacctggccgaagaactgacctttgacatagactataaaacgtccgaggtcaatcaaagagtgttctctttggacgaagtgtttgaaattgcgaacttcaacaactacttgaatcagtccggcatcaccaaattcaacactatcataggtgggaagttcgtcaatggcgaaaacacaaagaggaaaggaatcaatgaatacatcaatctgtactcacaacagataaatgacaagaccctcaaaaagtataagatgtcagttctcttcaagcagattctctctgatacggagtccaagagcttcgtcatcgacaaactggaggacgattctgacgtggtcactacgatgcagtcgttttatgagcagatcgcagcgttcaaaaccgtcgaggaaaagagcataaaggaaaccctttctctcttgtttgacgacctgaaggcccaaaaactcgatctctccaagatatacttcaaaaatgataagtctttgactgacctctcccagcaggtcttcgacgactattccgtcatcggaacagccgtgctggagtatataacgcagcaaatcgctcctaaaaatttggacaatcctagcaagaaggaacaagagcttattgccaagaagactgaaaaagccaagtatctcagcctggaaacaattaaactggcgcttgaagagtttaataagcaccgcgacatcgacaaacaatgccgcttcgaggagattctggctaacttcgcggccatccctatgattttcgacgagattgcgcaaaacaaggataacttggcacagattagcattaagtaccagaaccaggggaagaaggaccttctgcaggcgtcagctgaggacgatgtgaaggcgatcaaagatctcttggaccagactaataatctgctccataaactgaagatttttcatatctcacagagcgaggataaggccaacatccttgacaaggacgagcatttttatttggtcttcgaagagtgctacttcgagttggcaaatattgtgccactttacaacaagataaggaattacatcacccaaaagccgtattcagatgagaaattcaagctgaacttcgagaactcaacactggccaacggctgggacaagaataaggaacctgacaacacagctatactgttcattaaggatgataaatattacctcggtgtcatgaacaaaaagaacaacaagatcttcgacgataaagctataaaggagaacaagggagagggctacaaaaagatcgtttataaattgctcccaggcgctaacaaaatgctgcccaaggtcttcttttcggccaagtcaattaagttctacaacccttcggaagatatacttagaatcaggaatcattccacccatacgaagaatggtagcccgcagaagggctacgagaaattcgagtttaacattgaagattgtaggaagttcatcgatttctataaacaatctatttctaagcatccggagtggaaagatttcggttttcggttctcagacacccagcgctacaactctatcgacgagttttatcgggaggtcgagaaccagggttacaagctcacttttgaaaacatcagcgagtcctacattgattccgtggtgaaccaaggcaaactctacttgtttcagatctacaataaggacttctcagcttactctaagggcagacctaatctccataccctgtattggaaagcgctcttcgatgaaaggaatcttcaggacgtggtttacaagcttaatggcgaggctgagctgttctataggaagcagagcatcccaaagaagataacacatccggccaaggaagcaatcgctaacaagaacaaagacaatcctaaaaaagagtcagtctttgagtacgatctgataaaagataagaggtttacagaggataaattcttcttccactgcccaattactataaatttcaagtcgtctggagctaacaagtttaacgacgagatcaaccttctcttgaaagaaaaagcaaacgacgttcacatccttagcatcgaccgcggtgagcggcaccttgcgtactacactctcgttgatggcaaaggcaacatcattaagcaggacacctttaacattataggcaacgacagaatgaaaacgaactaccacgataagttggccgccatcgaaaaggaccgcgactcagctcgcaaggattggaagaaaattaataacataaaggagatgaaagaggggtacctttcccaggtggtgcatgaaatcgctaagcttgttattgagtataacgcgattgtggtgttcgaggaccttaacttcgggttcaagcgcggtcggtttaaagtcgaaaagcaggtgtatcagaaactggagaaaatgctgattgagaagcttaactacctggttttcaaggacaatgaattcgataaaactggtggggtgcttagagcgtatcaactgacagcgccattcgagacatttaaaaagatgggtaaacagacagggattatctactatgtgcctgcaggattcacctctaaaatctgcccagtcactggcttcgtgaaccagctgtacccgaagtacgagagcgtttctaagtcccaggaattcttcagcaagttcgataagatatgctacaatttggacaaagggtacttcgagttctccttcgattacaagaactttggagataaggcggctaagggcaagtggactatcgcatcgtttggatctagactcatcaattttaggaactcagataagaatcacaactgggatacaagggaagtctaccccacgaaggagttggagaagctgctcaaggattatagcatagagtacggacacggcgagtgtataaaggccgccatttgcggagagtcggacaagaagttctttgctaagttgacatccgtgctcaatactattctgcagatgagaaactcgaagaccggcacggagctggactacctgatttctcctgtggcagatgttaatggcaacttcttcgactctcgccaggccccgaagaacatgccccaagatgctgatgcaaatggagcctaccatatcggtctcaagggcttgatgcttcttggccggattaaaaacaatcaagagggtaagaaactgaatctcgtcatcaagaacgaggagtacttcgagtttgtccaaaatagaaacaactaa

SEQ ID NO: 6 - protein, 1307 aa, Acidaminococcus sp. BV3L6
  cpf1 (1)..(1307)
  RuvCI_active_residue (908)..(908)
  RuvCII_active_residue (993)..(993)
  RuvCIII_active_residue (1263)..(1263)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 7 - DNA, 3924 bp, Acidaminococcus sp. BV3L6
  cpf1 (1)..(3924)
atgacccaatttgaaggttttaccaatttataccaagtttcgaagacccttcgttttgaactgattccccaaggaaaaacactcaaacatatccaggagcaagggttcattgaggaggataaagctcgcaatgaccattacaaagagttaaaaccaatcattgaccgcatctataagacttatgctgatcaatgtctccaactggtacagcttgactgggagaatctatctgcagccatagactcctatcgtaaggaaaaaaccgaagaaacacgaaatgcgctgattgaggagcaagcaacatatagaaatgcgattcatgactactttataggtcggacggataatctgacagatgccataaataagcgccatgctgaaatctataaaggactttttaaagctgaacttttcaatggaaaagttttaaagcaattagggaccgtaaccacgacagaacatgaaaatgctctactccgttcgtttgacaaatttacgacctatttttccggcttttatgaaaaccgaaaaaatgtctttagcgctgaagatatcagcacggcaattccccatcgaatcgtccaggacaatttccctaaatttaaggaaaactgccatatttttacaagattgataaccgcagttccttctttgcgggagcattttgaaaatgtcaaaaaggccattggaatctttgttagtacgtctattgaagaagtcttttcctttcccttttataatcaacttctaacccaaacgcaaattgatctttataatcaacttctcggcggcatatctagggaagcaggcacagaaaaaatcaagggacttaatgaagttctcaatctggctatccaaaaaaatgatgaaacagcccatataatcgcgtccctgccgcatcgttttattcctctttttaaacaaattctttccgatcgaaatacgttatcctttattttggaagaattcaaaagcgatgaggaagtcatccaatccttctgcaaatataaaaccctcttgagaaacgaaaatgtactggagactgcagaagcccttttcaatgaattaaattccattgatttgactcatatctttatttcccataaaaagttagaaaccatctcttcagcgctttgtgaccattgggataccttgcgcaatgcactttacgaaagacggatttctgaactcactggcaaaataacaaaaagtgccaaagaaaaagttcaaaggtcattaaaacatgaggatataaatctccaagaaattatttctgctgcaggaaaagaactatcagaagcattcaaacaaaaaacaagtgaaattctttcccatgcccatgctgcacttgaccagcctcttcccacaacattaaaaaaacaggaagaaaaagaaatcctcaaatcacagctcgattcgcttttaggcctttatcatcttcttgattggtttgctgtcgatgaaagcaatgaagtcgacccagaattctcagcacggctgacaggcattaaactagaaatggaaccaagcctttcgttttataataaagcaagaaattatgcgacaaaaaagccctattcggtggaaaaatttaaattgaattttcaaatgccaacccttgcctctggttgggatgtcaataaagaaaaaaataatggagctattttattcgtaaaaaatggtctctattaccttggtatcatgcctaaacagaaggggcgctataaagccctgtcttttgagccgacagaaaaaacatcagaaggattcgataagatgtactatgactacttcccagatgccgcaaaaatgattcctaagtgttccactcagctaaaggctgtaaccgctcattttcaaactcataccacccccattcttctctcaaataatttcattgaacctcttgaaatcacaaaagaaatttatgacctgaacaatcctgaaaaggagcctaaaaagtttcaaacggcttatgcaaagaagacaggcgatcaaaaaggctatagagaagcgctttgcaaatggattgactttacgcgggattttctctctaaatatacgaaaacaacttcaatcgatttatcttcactccgcccttcttcgcaatataaagatttaggggaatattacgccgaactgaatccgcttctctatcatatctccttccaacgaattgctgaaaaggaaatcatggatgctgtagaaacgggaaaattgtatctgttccaaatctacaataaggattttgcgaagggccatcacgggaaaccaaatctccacaccctgtattggacaggtctcttcagtcctgaaaaccttgcgaaaaccagcatcaaacttaatggtcaagcagaattgttctatcgacctaaaagccgcatgaagcggatggcccatcgtcttggggaaaaaatgctgaacaaaaaactaaaggaccagaagacaccgattccagataccctctaccaagaactgtacgattatgtcaaccaccggctaagccatgatctttccgatgaagcaagggccctgcttccaaatgttatcaccaaagaagtctcccatgaaattataaaggatcggcggtttacttccgataaatttttcttccatgttcccattacactgaattatcaagcagccaatagtcccagtaaattcaaccagcgtgtcaatgcctaccttaaggagcatccggaaacgcccatcattggtatcgatcgtggagaacgcaatctaatctatattaccgtcattgacagtactgggaaaattttggagcagcgttccctgaataccatccagcaatttgactaccaaaaaaaattggacaacagggaaaaagagcgtgttgccgcccgtcaagcctggtccgtcgtcggaacgatcaaagaccttaaacaaggctacttgtcacaggtcatccatgaaattgtagacctgatgattcattaccaagctgttgtcgtccttgaaaacctcaacttcggatttaaatcaaaacggacaggcattgccgaaaaagcagtctaccaacaatttgaaaagatgctaatagataaactcaactgtttggttctcaaagattatcctgctgagaaagtgggaggcgtcttaaacccgtatcaacttacagatcagttcacgagctttgcaaaaatgggcacgcaaagcggcttccttttctatgtaccggccccttatacctcaaagattgatcccctgactggttttgtcgatccctttgtatggaagaccattaaaaatcatgaaagtcggaagcatttcctagaaggatttgatttcctgcattatgatgtcaaaacaggtgattttatcctccattttaaaatgaatcggaatctctctttccagagagggcttcctggcttcatgccagcttgggatattgttttcgaaaagaatgaaacccaatttgatgcaaaagggacgcccttcattgcaggaaaacgaattgttcctgtaatcgaaaatcatcgttttacgggtcgttacagagacctctatcccgctaatgaactcattgcccttctggaagaaaaaggcattgtctttagagacggaagtaatatattacccaaacttttagaaaatgatgattctcatgcaattgatacgatggtcgccttgattcgcagtgtactccaaatgagaaacagcaatgccgcaacgggggaagactacatcaactctcccgttagggatctgaacggggtgtgtttcgacagtcgattccaaaatccagaatggccaatggatgcggatgccaacggagcttatcatattgccttaaaagggcagcttcttctgaaccacctcaaagaaagcaaagatctgaaattacaaaacggcatcagcaaccaagattggctggcctacattcaggaactgagaaactga

SEQ ID NO: 8 - DNA, 3924 bp, Acidaminococcus sp. BV3L6
  cpf1 (1)..(3924)
atgacccaattcgaaggcttcactaatctgtaccaggtttcaaagactcttagatttgaactgatacctcagggcaaaacactgaagcacatccaggagcagggattcatcgaggaagacaaggctcgcaacgaccactataaagaactcaaacccattatcgatcggatctacaaaacatacgcggaccagtgcttgcagcttgtccaattggactgggaaaacctgtccgccgccattgactcttacaggaaggagaagactgaggaaacgagaaacgcgcttatcgaggagcaggccacctaccggaacgcgatccacgactacttcattggtaggacagacaacctcactgatgcgattaacaagcgccacgcggaaatatataaaggcctgttcaaagctgaactgttcaacggtaaagttctgaaacagctcggcaccgtcacaacaaccgagcatgagaacgccctcttgcgctctttcgacaaattcactacttacttctccggcttctacgagaacaggaaaaacgtcttttcggcagaagacataagcaccgctatccctcacagaatcgtgcaggacaacttcccgaaattcaaagagaactgccacatattcacacgcctcattactgctgtgccgtctctcagagagcactttgagaacgtgaagaaggctattggaatctttgtgtcaacatctattgaggaggtgttctcgttccctttttacaaccagcttttgactcagactcagatcgacctctacaaccagctcctgggagggatatcccgcgaagccgggactgagaagataaagggcctcaatgaggtgttgaacctcgccatccagaaaaacgatgagaccgcacacatcatcgcgtcgctcccgcatcgcttcataccactctttaagcagatcctgtccgacagaaataccctgtcctttatccttgaggaattcaagtcggatgaggaggtgatccagtcattttgcaaatacaagacccttcttcggaacgaaaatgtgctggaaaccgccgaggctctcttcaacgagttgaactccatcgacctgactcacatcttcattagccataaaaagcttgaaaccatttcttctgcgctgtgcgatcattgggacacactgaggaacgccctctatgaacggcggatcagcgagttgactgggaaaatcacaaagtccgcgaaagagaaagtccagaggtccctcaagcatgaagatattaatctccaggagatcatctcagcagcgggcaaggagttgtccgaagcattcaagcaaaagacatcggagatccttagccatgcgcacgctgctctggaccaacccctgcctacaacccttaagaaacaggaggaaaaggaaattctcaagagccaattggactctctgctgggcctttaccatctcctggactggtttgctgtcgacgaatcgaacgaggtcgaccccgagttttcggcgagactgactgggataaaactcgaaatggagccatccctgagcttttacaacaaggccaggaattatgctaccaagaagccgtactccgttgagaaattcaagctcaacttccagatgccaactctggcatctggctgggacgtgaataaggaaaagaataatggggccattctgtttgtcaaaaatggtctctattatttgggcattatgccgaagcaaaaagggaggtacaaggcactcagctttgagcctactgaaaagacatctgagggcttcgataagatgtactacgactacttccctgatgctgcgaaaatgatacctaagtgctccactcaacttaaggcagttactgcccattttcagactcacacgacgcctatactcctgtccaacaatttcattgagcccctggagatcaccaaggagatctacgacctcaacaacccggaaaaggagccgaaaaagttccagacggcttatgccaagaaaacaggagaccaaaagggctaccgggaagccctgtgcaagtggatcgattttactcgcgatttcctctccaagtacactaagactacatcaatagatctgtctagccttcggcccagctcgcaatacaaggaccttggagagtactacgcggagctgaacccactcctttaccatatttcctttcaaagaatcgcggagaaggagataatggacgccgtcgaaaccggaaaactttatcttttccaaatttacaacaaggactttgctaaaggccaccacgggaagcctaacctccacaccctctattggactgggctcttttctcccgaaaatctcgcaaaaacctcaattaagctcaatggccaagcggagttgttctatagacctaaatcgaggatgaagagaatggctcaccgccttggggagaagatgcttaacaaaaagcttaaggatcagaaaactcccattcctgataccctgtaccaggagctttacgattacgttaaccatagactctcccatgacctgtcagatgaagcccgcgccctgctccccaacgtcattaccaaagaagtctcgcatgaaatcattaaggaccgcaggtttactagcgataaattcttcttccatgttcctatcacactgaactaccaggctgcgaactcaccatccaagttcaatcagcgcgttaatgcgtatttgaaggaacacccggagacccctatcatcgggattgacagaggggaacggaaccttatttatataacagtcattgacagcaccggcaagatcctggagcaaagaagcttgaatacaattcaacaatttgactaccagaaaaagttggacaacagggagaaagaaagggtcgccgcgaggcaagcctggtctgtggttggcaccatcaaagaccttaagcagggatacctgagccaggtgattcatgaaatcgttgatctgatgattcactaccaggctgtggtggttctcgaaaatctcaacttcggttttaagtcgaaaagaacgggcatcgcggaaaaggccgtctaccagcaattcgagaagatgctgattgataagctgaattgcctcgtcctgaaggattaccctgcggaaaaggtcggcggagtgctgaacccttaccaactgaccgatcagtttacgagctttgccaaaatggggacccagtcaggcttcctcttctacgtcccggcaccctatacatcaaagattgatccgctcactggcttcgtggatcccttcgtttggaagacaattaagaatcatgagtcccggaagcactttcttgaggggttcgatttccttcattatgacgtcaaaactggcgacttcatattgcactttaagatgaatcgcaacctctctttccaaagggggcttcccggcttcatgccagcttgggacatcgtgttcgagaagaacgaaacccaatttgatgccaagggcaccccattcattgcaggcaagcgcattgtgccagtcattgaaaatcatcgctttactggtaggtacagggacctgtaccccgccaacgagcttatcgcattgctcgaagagaagggcatcgtctttcgggatggatccaatatcctgcctaagctgctcgagaatgatgattcgcacgctatcgatacgatggtcgcgttgataaggtccgtgctgcagatgagaaattcaaatgcggccacaggcgaggattacataaatagcccggtgagagatctcaacggagtgtgttttgacagcaggttccaaaacccagaatggccgatggacgcagacgctaatggagcttaccatatagcacttaaggggcagctgctcctcaaccacctgaaagagtctaaggacctcaaactccagaacggcatctctaaccaagactggctggcctacatccaagaattgagaaactaa

SEQ ID NO: 9 - protein, 1206 aa, Lachnospiraceae bacterium MA2020
  cpf1 (1)..(1206)
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 10 - DNA, 3621 bp, Lachnospiraceae bacterium MA2020
  cpf1 (1)..(3621)
atgtattatgagagtttaacaaagcagtatccggtaagtaaaacaataaggaatgaattgattccgattggaaaaacgctagataatattcgtcagaataatatattagagtctgatgtaaagaggaagcagaattacgaacatgttaaagggattctggatgaatatcataaacagcttataaatgaggcattggataattgtacgttaccaagccttaaaattgctgcagaaatatatctgaagaatcaaaaagaagtaagtgatagagaagattttaacaaaacacaggatttgttaagaaaagaagtggtcgaaaaattaaaggcccatgagaattttactaagattggtaagaaggatattttagatttattagagaaattgccttctatttcagaagatgattacaacgctttggagagttttaggaatttctacacttattttacaagttacaataaagtgagagaaaatctttattcagataaggaaaagtcatctactgttgcctatagattgattaatgagaatttcccaaagtttttggataatgtaaagagttatagatttgtaaaaacagcgggcattttagcagatggtttaggggaagaagagcaagatagtctttttatagttgagactttcaacaagactttaacgcaggatggaattgatacatataattctcaagttggtaagataaattcaagcatcaatttgtataatcagaaaaatcagaaggcgaatggatttagaaaaatcccaaagatgaagatgctttataaacagatattatctgatagagaagaatcttttattgatgagttccaaagtgatgaggtattgatagataatgttgaatcctatggaagtgtattgattgaaagtcttaaatcatccaaggttagtgcattttttgatgcattaagagaatcaaaaggaaagaatgtttatgtaaagaatgatttggcaaaaacagcgatgtcaaatattgtttttgaaaattggagaacttttgatgatttgttaaatcaggaatatgatttagctaatgagaataaaaagaaggatgataagtattttgaaaaacgtcaaaaagaattaaagaagaataaaagctattctttggaacatctatgtaatttatcagaagatagttgtaatttgattgaaaattacattcatcagatttctgatgacatagaaaatattattatcaataatgaaactttcttgagaattgtaattaatgaacatgatagaagcagaaagttagctaaaaatagaaaagctgtgaaagcaattaaagactttttggattcaattaaggtattagaacgtgaattaaaacttattaatagtagcggacaagaattggaaaaagatttaattgtttattcggcgcatgaagaattacttgttgaattaaagcaggtggattctttatataatatgacaagaaattatttaacgaaaaagccattttccaccgagaaagtaaaactaaattttaatagatccacattgctaaatggatgggataggaataaagaaacagataacctgggagttttgcttttaaaagatgggaaatattatttaggtattatgaatacatctgctaataaagcttttgtaaatccgccagtagcaaaaacagaaaaagtatttaaaaaagtggattacaagttgttgcctgtaccaaatcaaatgcttccgaaagtctttttcgcgaaatcaaatattgatttttataatccatcatcagagatttattcaaattataagaaaggtacgcataagaaaggaaacatgttttcactggaagactgtcataatttgatagatttctttaaggaatctattagtaagcatgaagattggtctaaatttggatttaagttttctgatacagcatcctataatgatattagtgaattttatcgagaagtagaaaagcaaggatataagcttacatatacagatattgatgaaacatatataaatgacttgattgaaagaaatgaattatatttgtttcagatatataacaaagatttttctatgtatagtaaaggcaagcttaatttgcatacattgtatttcatgatgctatttgatcaaaggaatattgatgatgttgtgtataagctaaatggtgaggcggaggttttctatcgacctgcttcaatttcagaagatgaattaattattcataaggctggagaagagataaagaataagaatccaaatagggcaagaacaaaagaaacaagcacattttcttatgatattgtgaaggataaaaggtatagcaaggataaatttacacttcatattcctatcactatgaactttggcgttgatgaagtaaaacgctttaacgatgctgtaaatagtgcgataagaattgatgaaaatgtaaatgtaattggtatagatcgtggagagaggaatcttttatatgtagttgtcattgattcaaaaggtaatatattggaacaaatatcattaaattcaattattaataaggaatatgatattgaaacagattatcatgcattattagatgagagggaaggcggtagagataaagcacgtaaagattggaatacagtagaaaatataagggatttaaaggctggatatttaagtcaggtggttaatgtagttgctaagcttgtacttaaatataatgcaattatttgtttggaagatttaaattttggctttaaaagaggtagacagaaagttgaaaaacaggtgtaccagaagtttgagaaaatgcttatagataagttgaattatcttgtaattgataagagtagggaacaaacttcaccgaaggaattaggcggagcacttaatgcattgcaattaacatctaagtttaaaagttttaaggaattgggaaaacaaagtggtgtgatttattatgtccctgcgtatctcacaagtaagattgatccaactacgggatttgcgaatttattttacatgaagtgtgaaaatgttgaaaaatcaaaaagattttttgatggtttcgactttataagatttaatgccttagagaatgtatttgaatttggatttgattataggtcatttacacagagagcgtgcggtattaacagtaaatggactgtttgtaccaatggtgaaagaataattaagtaccgtaatccagataaaaataatatgttcgatgaaaaagttgttgtagttacagatgaaatgaaaaatttatttgaacagtataagattccgtatgaagatggaagaaatgtaaaagacatgattatatccaatgaagaagcggagttttatagaagattatatagattattgcaacaaacattacaaatgagaaatagtacttcagacggaacaagggattatataatttcacctgtaaagaataagagagaggcatattttaattcagaattgtcggatggttctgtaccaaaggatgcggatgcaaatggagcgtataatattgcaaggaaaggtctttgggtattagagcaaataaggcagaaaagtgagggagaaaagattaatttagcaatgacaaatgctgaatggcttgaatatgcgcaaacgcatttgttgtaa

SEQ ID NO: 11 - DNA, 3621 bp, Lachnospiraceae bacterium MA2020
  cpf1 (1)..(3621)
atgtactacgagtcattgactaaacagtatccagtgagcaaaaccatacggaacgagcttatccctatcggcaaaactctcgacaacatacgccaaaacaacatcctggagtccgacgtgaagcggaaacagaattacgagcacgttaaaggcatccttgacgaataccataagcaacttatcaatgaggctctcgacaattgcactcttcccagcctcaaaattgctgccgagatctacctgaagaaccaaaaggaggttagcgacagagaggactttaacaagactcaggacttgttgaggaaggaagtcgtggagaaacttaaagctcatgagaacttcacaaagataggcaagaaagatattttggacctgctggaaaagcttccgtctatctcagaggacgattacaacgctcttgagtcctttaggaacttctatacgtactttacgtcatataacaaggtcagggagaacttgtattctgacaaggaaaaatcctctacggttgcttatcggctcatcaacgaaaacttccccaagttcctggacaacgtcaaatcatacaggttcgtcaaaaccgcggggattctcgcagatggcctcggtgaggaggagcaggattctctcttcatagttgagacttttaacaagacactcacccaagatggtattgacacttacaactcccaggtgggaaaaatcaactcctctataaacctctacaatcaaaagaatcagaaggccaacggattccggaagatcccgaagatgaagatgctttataagcaaattttgagcgatcgggaagagtcttttatcgatgaattccagtctgatgaggttttgatcgataacgtcgagagctatggctcagtgttgatcgagtccctcaagagcagcaaggtctcggctttctttgacgcgctccgcgaatcaaagggcaagaatgtttatgtcaagaatgatcttgccaagacggcaatgtctaatattgtcttcgagaactggcgcactttcgacgatctcttgaatcaggaatatgacctcgcgaacgagaacaaaaagaaggacgacaaatacttcgagaagaggcagaaggaactcaagaagaataagtcttactccctcgagcatctctgtaatctgtctgaggattcctgtaacttgatcgagaactacatccaccagatcagcgacgatatagagaatattattatcaataacgagaccttcctgcggattgttataaacgagcacgacaggtccagaaagttggccaagaatcgcaaggctgtcaaggccatcaaagattttctggattcaattaaggtgctcgagagagaattgaagctcataaactcctcaggccaggagctggaaaaggatctgattgtgtactcggctcatgaggagctgctcgtcgaactcaagcaggtggattctctgtataacatgactagaaactatctgaccaaaaagcctttttcaactgaaaaagtgaagttgaacttcaatcggtctacgctcctgaacgggtgggataggaacaaggaaaccgacaacctgggagtgctcctccttaaggatggcaagtactacctcggcatcatgaatacttcggccaacaaggccttcgtgaatcctccagtcgcgaagaccgaaaaggtcttcaagaaagtggactacaaattgctcccagttcccaatcaaatgctgcccaaagtgttcttcgcgaagtcgaatatagatttctataacccatccagcgagatttattcaaactacaagaaaggaacacacaaaaagggaaacatgttctctttggaggactgtcacaaccttatcgatttcttcaaggaatcaatttcaaagcacgaggattggtccaagttcggattcaagttctctgatacggcttcgtataatgatatctcagagttttacagagaggtcgaaaagcagggctacaaactgacttatacggatatcgacgagacgtacataaacgacttgatcgaaaggaatgagctttatctttttcaaatctacaacaaggatttttctatgtactcgaagggcaagctcaacctgcatactctgtattttatgatgctctttgaccagcggaacattgacgatgtggtgtacaagctgaacggagaagcagaagtgttctaccggccggcctccatttcggaggatgaactcattattcacaaggcgggggaggagattaaaaacaagaaccctaaccgcgcgaggacgaaggagacttccactttctcatatgatatcgttaaggataagaggtacagcaaagacaagtttacactccatattccgattactatgaactttggcgtggacgaggtgaagaggttcaatgacgcagtcaactcagcgattaggatcgacgagaatgtcaacgtcataggtatagacagaggagagagaaacctcctgtacgtcgtggtcatcgactccaaaggcaatatactggaacaaattagcctgaactcaatcataaacaaggagtacgacatcgaaaccgactaccacgctctcctggatgagcgggaaggcggtcgggataaagccaggaaggattggaacactgtggagaacataagagatcttaaggccggttacctctcacaggtcgttaacgtggttgcgaagttggttctcaagtacaatgccatcatttgcctcgaggacctgaatttcgggttcaaaaggggtaggcagaaggtggagaagcaagtttaccaaaagtttgagaagatgctgatcgacaagcttaattacctcgttatagacaaatcgcgggagcaaacctccccgaaagagctgggcggcgcacttaatgcacttcagctgacttcgaagttcaagtcgtttaaggaactcggcaagcaatcgggtgttatttactacgtcccagcttacttgacgtcgaaaattgaccctactactggctttgcgaacttgttctatatgaaatgcgagaacgtcgagaaaagcaagaggtttttcgatgggtttgacttcatcaggttcaacgcccttgaaaacgttttcgagtttgggtttgattacaggtccttcacacagagggcctgtggtatcaattcaaagtggactgtgtgtacaaacggcgaacgcataatcaaataccgcaatcctgacaaaaacaatatgttcgacgaaaaggttgttgtcgtgaccgacgagatgaagaacctttttgagcagtataagataccatacgaggatgggaggaatgttaaagacatgataatctccaacgaggaggccgagttttatagacgcctgtatcggctcttgcagcaaaccctccaaatgagaaattcgacctctgatggcacaagggattacatcatctccccggtcaagaacaagagggaggcctattttaattccgaactgagcgacggcagcgtcccgaaggatgcggacgccaatggagcgtataacatcgctaggaaaggcctttgggttctcgagcaaataaggcaaaagagcgagggggagaaaatcaacctggcgatgacaaatgcggagtggttggagtatgctcaaacacatctcctgtag

SEQ ID NO: 12 - protein, 1238 aa, Candidatus Methanoplasma termitum
  cpf1 (1)..(1238)
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 13 - DNA, 3717 bp, Candidatus Methanoplasma termitum
  cpf1 (1)..(3717)
atgaacaactatgatgagtttaccaaactgtacccaatacagaaaacgataaggttcgaattgaagccgcagggaagaacgatggaacacctcgaaacattcaactttttcgaagaggacagggatagagcggagaaatataagattttaaaggaagcaatcgacgagtatcataagaagtttatagacgaacatctaacaaatatgtctcttgactggaattctttaaaacagatttcagagaaatactataagagtagagaggaaaaagacaagaaagtttttctgtcagaacagaaacgcatgaggcaagagatagtttctgagttcaaaaaagacgatcggtttaaagatcttttttcaaaaaaattgttttctgaacttctcaaggaagagatttacaaaaaaggaaaccatcaggaaattgacgcattgaaaagttttgataaattctcaggctattttattgggttgcatgagaaccgaaaaaatatgtattctgacggagacgagatcacggctatctctaaccgtattgtaaatgagaatttcccgaagttcctcgacaaccttcagaaatatcaggaagctcgtaaaaaatatccagagtggatcattaaggcagaatctgctttagttgcacataatatcaagatggatgaagtcttttccttagagtatttcaacaaagtcctgaatcaagaaggaatacagagatacaatctcgccctaggtggctatgtgaccaaaagtggtgagaaaatgatggggcttaatgatgcacttaatcttgcccatcaaagtgaaaaaagcagcaagggaaggatacacatgactccactcttcaaacagattctgagtgaaaaagagtccttttcttatataccagatgtttttacagaagactctcaacttttaccatccattggtgggttctttgcacaaatagaaaatgataaggacgggaatatttttgacagagcattagaattgatatcttcttatgcagaatacgatacagaaaggatatatatcaggcaagcggacataaacagagtttctaatgttattttcggggagtggggaacactgggggggttaatgagggaatacaaagcagactctatcaacgacatcaatttggagagaacatgcaagaaggtagacaagtggctcgactcaaaggagtttgcgttatcagatgtattagaggcaataaaaagaaccggcaataatgatgcttttaatgaatatatctcaaagatgcgcactgccagggaaaagattgacgctgcaagaaaggaaatgaaattcatttcggaaaaaatatctggagacgaagaatcgatccatattatcaaaaccttattggactcggtgcaacagtttttacattttttcaatttattcaaagcgcgtcaggacattcctcttgatggagcattctatgcggagttcgatgaagtccatagcaaactgtttgctattgttccgttgtataataaggttaggaactatcttacgaaaaataaccttaacacgaaaaagataaagctaaacttcaagaatccaactctggcaaacggatgggatcaaaacaaggtatatgactacgcctccttaatctttctccgcgatggtaattattatctcggaataataaatccaaaaaggaaaaagaatattaaattcgaacaagggtctggaaatggcccattctaccggaagatggtgtacaaacaaattccagggccgaacaagaacttaccaagagtcttcctcacatctacgaaaggcaaaaaagagtacaagccgtcaaaggagataatagaaggatatgaagcggacaaacacataagaggagataaattcgatctggatttctgtcataagctgatagacttcttcaaggaatccatcgagaagcacaaggactggagtaagttcaacttctatttctctccaactgaatcatatggagacatcagcgaattctatctggatgtagaaaaacagggataccggatgcattttgagaatatttctgccgagacgattgatgagtatgtcgaaaagggggacttattcctcttccagatatacaacaaagactttgtgaaagcggcaaccggaaaaaaagatatgcacaccatttattggaacgcggcattctcgcccgagaaccttcaggatgtggtagtgaaactgaacggtgaagcagaacttttctacagagacaagagcgacatcaaggagatagttcacagggagggagagatactggtcaatcgtacctacaacggcaggacacctgtgcctgacaagatccacaaaaaattaacagattatcataatggccgtaccaaagatctcggagaagcaaaagaatacctcgataaggtcagatatttcaaagcgcactacgacatcacaaaggatcgcagatacctgaatgataaaatatacttccatgtgcctctgacattgaatttcaaagcaaacgggaagaagaatctcaataagatggtaattgaaaagttcctctcggacgaaaaagcgcatattattgggattgatcgcggggaaaggaatcttctttactattctatcattgacaggtcaggtaaaataatcgatcaacagagcctcaacgtcatcgatggattcgattaccgagagaaactgaatcagagggagatcgagatgaaggatgccagacaaagctggaatgctatcgggaagataaaggacctcaaggaagggtatctttcaaaagcggtccacgaaattaccaagatggcgatacaatacaatgccattgttgtcatggaggaactcaattatgggttcaaacgcggacgtttcaaagttgagaagcagatatatcagaaattcgagaatatgctgattgacaagatgaattatctggtattcaaggatgctccggatgaaagtccgggaggagtcctcaatgcatatcagcttactaatccgcttgaaagtttcgctaaacttgggaaacagacaggaattcttttctatgttccggcagcctatacttcgaagatagatccgacgaccgggtttgtcaatcttttcaatacttcaagtaaaacgaacgcacaggaaagaaaagaattcttgcaaaaattcgagtcgatctcctattccgctaaagacggaggaatattcgcattcgcgttcgattatcggaagttcggaacgtcaaaaacagaccacaaaaatgtatggaccgcatacacgaacggggaaaggatgaggtacataaaagagaaaaaacgcaacgaactgttcgacccctcgaaggagatcaaagaggctctcacttcatcaggaatcaaatatgacggcggacagaacatattgccagatatcctgaggagcaacaataacggtctgatctacacaatgtattcctctttcatagcggccattcaaatgagggtctatgacgggaaagaagactatatcatctcgccgataaagaacagcaagggagagttcttcaggaccgatccgaaaagaagggaacttccgatagacgcggatgcgaacggcgcgtataacattgctctcaggggcgaattgacgatgcgtgcgatagcggagaagttcgatccggactcggaaaagatggcgaagctagaactgaaacataaggactggttcgaattcatgcagacaaggggggattaa

SEQ ID NO: 14 - DNA, 3717 bp, Candidatus Methanoplasma termitum
  cpf1 (1)..(3717)
atgaacaattatgacgaatttacaaagctttacccaatacagaagaccatacgcttcgagctgaaaccccagggccggaccatggaacacctcgagacattcaacttttttgaggaggatcgggaccgggccgagaaatataagattttgaaagaggcgattgatgaataccataagaaatttatcgacgagcacctcaccaacatgagcctcgattggaacagccttaagcagatttcggagaaatactataagtctagggaagaaaaggataaaaaagtcttcctttccgagcagaaacggatgcgccaggagatagtgtcagagttcaagaaggatgatcggttcaaggacctgttctccaagaagctcttctccgaactcctgaaggaagagatttacaaaaaggggaaccatcaggagatagacgccctcaagtccttcgacaaattctctggttacttcattggattgcacgagaatcggaaaaatatgtattcagacggggacgagattacagcgatatctaacagaatcgtcaatgagaattttccgaagttccttgataatctgcagaagtaccaggaggcgcggaaaaaatatcccgaatggataatcaaggctgagtccgccctggtcgcacacaacattaaaatggatgaggttttttctctggagtactttaacaaggtgctcaatcaagaaggaatacagcgctacaacctggcgctcggaggctatgtcaccaaatctggggagaagatgatgggactgaacgatgccctgaatttggctcaccagtccgaaaaatcgagcaaaggcaggatacacatgacacctcttttcaaacagattttgagcgagaaggagtcattctcttacatccccgatgtgttcacagaggactcccaactccttccttctatcggtggcttctttgcccaaatcgagaatgataaagatgggaatattttcgatagggcgcttgaactcatctcgagctacgctgagtacgataccgagcgcatctacatcagacaagccgacataaaccgcgtcagcaatgttatctttggagaatgggggaccctgggtgggctcatgcgcgaatacaaagctgactccataaatgacatcaacctcgagcgcacctgcaagaaagtcgacaagtggctcgacagcaaggagtttgcccttagcgatgtgttggaggcaataaaaagaacagggaataatgatgcatttaacgagtatatttcgaaaatgcggacagccagagagaaaattgatgcggcacggaaagaaatgaaattcatttctgaaaaaatatctggggatgaggagtcaatccacattatcaagacccttctggattcggtgcaacagttcttgcatttcttcaacctgtttaaggccaggcaagacattcctcttgatggtgccttttatgcagagttcgacgaggtccactctaagctgttcgccattgttccactttacaacaaggtgaggaactacttgaccaaaaataacctgaacaccaaaaagataaaacttaattttaagaacccaacacttgccaatggctgggaccagaataaggtgtacgattatgcgtcgctgatctttcttcgcgacggtaattactatcttggaataataaatcctaagaggaaaaagaacattaaattcgaacaaggctcaggcaacggcccgttttatcgcaagatggtctataaacaaatccccggccccaacaagaaccttccaagggtttttttgaccagcacaaaggggaaaaaagagtacaagccaagcaaggagataatcgagggttatgaggctgacaagcacataaggggcgacaagtttgatctcgacttttgtcacaaactgatagatttcttcaaggagtccatagagaaacataaggactggtcgaaattcaatttttatttctcccccactgagagctatggcgacatctcggagttttacctcgatgtggagaaacaggggtacaggatgcatttcgaaaatatctccgcagagaccatcgatgagtacgtggagaagggtgaccttttcctgttccagatttacaacaaggatttcgttaaggcagcaacaggaaagaaggacatgcacacgatatattggaatgcagctttctcccccgagaacctgcaagacgtggttgtcaagctgaatggcgaggccgagctgttttatcgcgataagtccgacattaaggaaattgtgcatcgcgagggcgagatcctcgttaatagaacctataacggcaggacccctgtgcctgacaaaatccataagaaattaacagactaccacaacggccgcacgaaggacttgggtgaggcgaaggaatacttggataaggtccgctacttcaaagcgcactatgacatcacaaaggataggaggtatctcaacgataaaatatacttccacgtccctcttacacttaatttcaaagcgaatggaaagaaaaaccttaataagatggtgatcgaaaagttcctgtccgatgagaaagctcatataattgggatcgatcggggggagagaaacctcctctactattctataattgacaggtccggcaaaataatcgatcaacagtctcttaatgttatcgacggattcgactaccgcgaaaagttgaaccagcgcgagatcgagatgaaggatgcgaggcaatcatggaatgctattggcaagatcaaggacttgaaggagggatacctctcgaaagcggtgcacgaaattaccaagatggcgattcaatacaatgctatcgtcgtgatggaggagttgaattatggattcaagaggggcaggttcaaggttgaaaagcagatataccaaaagtttgaaaacatgttgattgataaaatgaactacttggtttttaaggacgcccccgatgaaagtcctggtggtgtgcttaatgcataccagctcaccaacccattggagtcgttcgcgaagttgggcaagcagacgggtatcttgttctacgtgcccgccgcatatacatccaagattgaccctaccacgggatttgtcaacttgttcaacacttcatccaagactaatgcgcaggagagaaaggagtttcttcagaaattcgaatcgatctcctacagcgcgaaggacggcgggatatttgccttcgcgtttgactacagaaagttcggaacttccaagaccgatcacaagaacgtgtggaccgcctacaccaatggcgaaaggatgcgctacataaaagagaaaaaaagaaatgagctgttcgatccctcgaaagagattaaggaagctttgacttcgtcaggaatcaaatacgacggtggacaaaatatactcccggacatcttgaggagcaacaacaacggtctgatatatacaatgtacagctcctttattgctgctattcaaatgcgcgtctacgacgggaaggaggactacataatatctccaattaagaactctaaaggagagtttttccgcacagatcctaagagaagagaacttcctattgacgcggatgccaatggggcgtacaacatagcgcttcgcggcgaactgaccatgagagccatagccgaaaaattcgacccagatagcgaaaaaatggcgaagttggagttgaagcacaaggattggttcgagtttatgcaaacaagaggagattga

SEQ ID NO: 15 - protein, 1373 aa, Moraxella bovoculi 237
  cpf1 (1)..(1373)
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 16 - DNA, 4122 bp, Moraxella bovoculi 237
  cpf1 (1)..(4122)
atgttgtttcaagactttactcatctataccccttatcaaaaaccgtgcgttttgaattaaagcccattgacaggacattagaacatatccatgccaaaaactttttgagccaagatgagaccatggcggacatgcaccaaaaggtgaaggtgatactcgacgattatcatcgtgattttatcgctgatatgatgggcgaagttaagctaactaagctggcagaattttatgatgtgtatttaaaatttagaaaaaatcccaaagacgatgaattgcaaaaacagctaaaggacttgcaagcagttttaagaaaagagattgtgaagcccatcggtaatggcggaaaatacaaggcgggttatgaccgcttatttggggcaaagctctttaaggacggcaaagagcttggtgatttggcgaaatttgtcatcgcccaagagggtgagtcatcgccaaagcttgctcaccttgcccattttgagaagtttagcacttactttactggttttcatgataaccgcaaaaacatgtacagcgatgaggataaacacaccgccattgcctatcgtctgatacatgaaaacctgccacgttttattgacaacctacaaatactgacaaccatcaaacaaaagcactcggcgttgtatgaccagattataaatgagctgactgcgagtggcttggatgtgtcgctggcaagtcatctggacggctatcacaagcttttaacccaagagggtatcacggcttataataccctgcttggcggtatcagtggcgaggcaggttctcccaagatacaaggtatcaatgagcttatcaatagtcatcacaaccaacattgccacaaatccgaacgtatcgccaaattacgccccctacacaaacaaatcctaagcgacggcatgagtgtgtcatttttgccaagcaaatttgccgatgatagcgagatgtgccaagcggtcaatgaattttaccgccattatgctgatgtttttgccaaggtgcaaagcttgtttgatgggtttgatgaccatcaaaaggacggcatttatgttgagcataaaaatttaaatgagctatccaagcaggcatttggtgattttgccttgttgggtcgggtgctggacggctattatgtggatgtggtgaatccagagtttaatgaaagatttgccaaagccaaaaccgacaatgccaaagcaaaactgacaaaagaaaaagacaaattcatcaaaggcgtgcattctttggcaagccttgagcaggcgatagagcattatactgctaggcatgatgatgagtctgtgcaggcgggcaaacttggacagtatttcaaacacggtctggcaggcgtggataatccaatccaaaaaatacacaacaaccacagcaccattaagggttttttggagcgtgaacgtccagcaggcgagcgagcattgcccaaaattaagtcaggcaaaaaccctgaaatgacgcagttaagacagctaaaagagctgctagacaacgccctaaacgtggcgcattttgccaagttattaacgaccaaaaccacgctagacaaccaagacggcaatttttatggtgagtttggggtgttgtatgatgagcttgccaagattcccacgctttataacaaagtgcgtgattatctgtcgcaaaagccatttagcaccgaaaaatataaattaaactttggcaatccgacattattaaacgggtgggatttgaataaagaaaaagataattttggggttatcttacaaaaagacggctgttattatttggcgttattggataaagctcataaaaaagtatttgataatgctccaaatacaggcaaaagtatttatcaaaaaatgatttataagtatctagaggtaagaaaacaatttcccaaggtgtttttttccaaagaggctattgctattaactatcacccttcaaaagaattggtggaaatcaaggataaaggcaggcaacgttctgatgatgaaaggttaaaattatatagatttattcttgaatgtttaaaaatacatccgaaatatgataaaaaatttgagggggctattggtgatattcagttgtttaaaaaggataaaaaaggtagagaggttcccatatcagagaaagatttgtttgataagataaatgggatatttagtagtaaaccaaagttagaaatggaagatttttttattggggaattcaagcgatacaatccaagtcaggatcttgtagatcagtataatatctataaaaaaatagattcgaatgacaataggaaaaaagaaaatttttataataaccacccaaaattcaagaaagacctagtgcgttattattacgaatctatgtgcaagcacgaagagtgggaagaatcgtttgaattttctaaaaaattgcaagatattggttgttatgttgatgtaaatgaattatttacagagattgaaactcgtagactgaattataaaatcagtttttgtaatatcaacgccgattatattgacgagttggttgaacaaggtcagttgtatttattccagatttataataaagatttctcgcccaaggctcacggtaagcccaatttacatactttgtattttaaggcgttgtttagcgaagataaccttgccgatccaatttataaattaaatggcgaggcacagatattttatcgtaaggcgtctttggatatgaatgaaaccaccattcatcgtgcaggcgaggtattagaaaataaaaatcctgataatccaaaaaagcgtcaatttgtctatgacatcatcaaagataaacgctatacccaagataagtttatgctacatgtgcctattaccatgaattttggtgtgcagggcatgacgattaaagaatttaataaaaaagttaatcaaagcatacaacaatatgatgaggtgaatgtcataggcatagaccgtggagagcgacatttgctatatctgaccgtgattaatagcaaaggtgaaatcttagaacagtgtagtctcaatgacatcactaccgcatcggcaaatggtacacaaatgaccacgccttatcataagatactggacaagagagaaatagaacgcctaaatgctcgtgtcggttggggtgagattgagaccataaaagagctaaaatcgggctatctaagccatgtggtacatcaaatcagccagcttatgcttaaatataatgccattgtggtgttagaggatttaaattttgggtttaagcgcggtcgctttaaggtggaaaaacaaatttaccaaaactttgaaaacgccttaatcaaaaagctaaaccatttggtattaaaagataaggcagatgatgagattggctcatacaaaaatgccctgcaactgaccaataattttactgatctaaaaagcattggcaaacaaacaggctttttattctatgtgcctgcatggaataccagtaaaatagaccctgaaacgggctttgtggatttgttaaaaccgcgttatgaaaatatcgctcagtcgcaagcgttttttggtaaatttgataagatttgttataacgcagataaggattattttgaatttcatattgattatgccaaatttactgacaaagccaaaaactctcgccaaatatggacgatttgctcgcatggcgataaacgttatgtgtatgacaaaaccgccaatcaaaataaaggagcggcaaagggtattaatgttaatgatgaattaaaatcgctatttgctcgtcatcacatcaatgaaaaacagccaaatctggttatggatatttgccaaaataacgacaaagaatttcataaatcgctgatgtatctattaaagacattgcttgcattacgatatagtaacgccagtagcgatgaagattttattttatcgcctgtggcaaatgatgagggtgtgttttttaattcggcattggcggatgacacacagccacaaaatgcggacgccaatggggcatatcatatcgcattaaagggcttatggctattaaatgaattaaaaaacagtgatgatttgaataaagtcaaacttgccattgacaatcaaacatggctaaacttcgctcaaaaccgctaa

SEQ ID NO: 17 - DNA, 4122 bp, Moraxella bovoculi 237
  cpf1 (1)..(4122)
atgctgtttcaggattttacgcatctgtatcccctctcgaagaccgtgagattcgaacttaagcctatcgacaggactctggagcatatccacgctaaaaactttctctcgcaagacgagactatggccgatatgcatcaaaaggttaaggtgatcttggatgactatcacagggactttattgccgacatgatgggtgaggtgaagctgacgaagctcgcagagttttacgatgtctacctcaagttcaggaagaatccgaaagatgatgaactccagaagcagttgaaggatctgcaggctgttctccggaaggaaatcgtgaaacccattggaaacggtggcaagtataaggcagggtatgatagactttttggagcgaagctcttcaaggatggtaaggagcttggcgatctcgccaagttcgttatcgcccaagaaggtgaatcgtcccctaaactggcgcaccttgcacatttcgagaaattctccacatattttacgggcttccacgataatagaaaaaatatgtattcggatgaagacaagcataccgctattgcataccgcctgatacacgagaacctgccccgctttatcgacaaccttcaaattcttaccaccattaagcagaagcacagcgcgctctacgaccagattatcaatgagctgaccgcgagcggtctggacgtctccctcgcctcgcacctcgatggctaccataaattgttgactcaggagggtattacggcttataatacgctgttggggggtatctccggagaggcaggcagccccaaaattcagggtataaatgagttgatcaattcgcatcacaatcaacactgccacaagtctgaacgcatcgccaagctccgccctctgcataaacagattttgtcggacgggatgtcagtttctttcttgccgagcaagtttgccgatgactctgaaatgtgccaggccgtgaatgagttttataggcattatgcagacgtcttcgcaaaggttcaatccctttttgatggcttcgatgatcaccaaaaggacggcatctacgttgaacacaagaatcttaatgagctgtccaaacaagccttcggcgactttgctctcttgggaagagtgcttgatggctactatgtggatgttgtgaatccggagtttaatgagaggttcgctaaagcgaaaactgacaatgcaaaagccaagcttaccaaggaaaaggacaagtttatcaaaggggttcattctctcgcatcgttggaacaagccattgagcactacactgctcgccacgatgatgagtcagtgcaagcagggaagctcggtcagtacttcaagcatggactcgcgggtgtggataatcccattcagaagattcataacaaccattcgacgatcaagggatttctcgaacgcgagcgcccggctggcgagagagccttgcccaagatcaagagcggaaaaaaccctgagatgacccagctgagacaattgaaggaactccttgataacgcgctgaacgtggctcactttgctaagttgcttactacaaagacgactctcgataaccaagatggcaatttctatggagaattcggtgttctttacgatgagcttgcgaagatcccgacgctttataacaaggtgagggactacctctcacaaaagccattctcaaccgagaagtacaagctcaactttgggaacccaacactcctcaatgggtgggacctcaacaaagaaaaagacaacttcggggttattcttcagaaagatggctgctactatctggcccttctggataaggcgcacaagaaagtgttcgacaacgccccgaacaccggaaaatctatttaccagaagatgatttataaatatctcgaggtgcgcaaacaattccctaaggtcttcttctcgaaggaagcaatcgccattaattaccacccgtctaaagaactcgtcgagatcaaggataagggccggcagcggtctgatgacgagagacttaagctgtacaggtttatcttggagtgtctgaagattcatccgaagtacgacaagaagttcgagggggctattggcgatattcaactgttcaagaaagacaagaaaggccgggaggttccgatctcggagaaggatctcttcgataagatcaatggcatcttctcctcaaagcccaagctggagatggaggatttcttcatcggagagtttaagcggtacaacccctctcaggacttggtcgatcagtacaatatatacaaaaagatcgattccaatgataatcggaagaaggaaaatttctataataatcaccccaaattcaagaaagatttggtgcggtattattatgaatcaatgtgcaagcacgaggagtgggaggagtcttttgagttctccaagaagctgcaagatatcggctgttacgtggacgtgaatgagcttttcactgagattgaaacccggaggcttaattacaagatttctttttgtaatatcaatgcggactacatcgatgagctggttgagcagggacagttgtatctcttccaaatatataacaaggatttctctcctaaagcccatggaaagccgaaccttcacaccttgtattttaaggcattgttctcagaggacaaccttgctgacccaatctacaaattgaacggcgaagcgcaaatcttctaccggaaagcctcccttgatatgaatgaaacgactatacatagggcaggcgaggtcctcgagaataagaaccctgataaccctaagaaacgccagttcgtctacgacatcatcaaggataaacgctacacgcaggacaagttcatgttgcacgtgccaattacgatgaatttcggggttcaaggtatgacgatcaaagaattcaataagaaagtgaatcagagcatccagcaatacgacgaggtcaacgttataggtatagacaggggtgagaggcacctgctgtaccttaccgtgataaactcaaagggggaaatcctggaacagtgttcactgaacgatattaccactgcctcagcgaacggtacacaaatgaccacgccgtatcacaagattctcgacaagagagaaatcgaacggttgaatgcgagggtggggtggggcgagatagagacaatcaaagaacttaagagcgggtacctctcgcacgttgtgcatcagatttcacagcttatgttgaagtacaatgccattgtcgtgctcgaagacctcaattttggattcaagagaggaaggttcaaggtggagaagcagatctatcaaaactttgagaacgcactcataaagaagctgaaccacctggtcttgaaagataaggctgacgacgagattggctcatacaagaacgcactccagttgacaaataacttcaccgacctgaagtccatcgggaagcagacaggcttccttttctacgtgcccgcttggaacacaagcaagatagaccctgagactggttttgtcgatcttctcaagccaagatatgaaaacatcgctcaatcgcaggcattttttggcaagttcgataagatctgctacaatgctgacaaagactacttcgagtttcacatcgactatgcgaagttcacagataaagcgaagaacagcagacaaatctggacaatctgtagccatggggacaagaggtacgtgtacgacaagactgccaaccaaaacaagggcgccgccaaaggaatcaatgtcaatgatgaacttaaaagcctgtttgcaaggcaccatattaatgagaagcagccgaatctggtgatggacatatgccagaacaacgacaaggaattccacaagtcacttatgtacctgcttaagaccctgttggcactccggtatagcaacgctagctctgatgaagactttatactgtccccggtggctaacgacgagggggtcttttttaacagcgcccttgctgatgatacccaacctcagaatgccgacgcgaatggcgcgtaccacattgcgctgaaagggttgtggctcttgaatgaactgaagaattcagacgacctcaacaaggtcaagctcgccatcgacaaccaaacatggctcaacttcgcgcaaaaccggtaa

SEQ ID NO: 18 - protein, 1228 aa, Lachnospiraceae bacterium ND2006
  cpf1 (1)..(1228)
  RuvCI_active_residue (832)..(832)
  RuvCII_active_residue (925)..(925)
  RuvCIII_active_residue (1180)..(1180)
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 19 - DNA, 3741 bp, Lachnospiraceae bacterium ND2006
  cpf1 (1)..(3741)
atgctcaaaaacgttggcattgacagactcgatgttgagaagggtcggaagaatatgtctaagctcgagaaattcactaactgttactctttgtccaaaacgctgcgcttcaaggcaattccggtcggcaagacgcaggagaacatcgacaataagagactgctggttgaggacgaaaagcgggccgaggactataaaggagttaagaagctcctcgatcggtactatctttcgttcattaacgatgttctccactcgattaaactcaagaatcttaataattatataagcctgttccgcaagaagacccgcactgaaaaagagaataaggagttggagaatctggagataaatctgcgcaaagaaatagccaaggccttcaagggcaacgaaggctacaagagcctgtttaaaaaggatataatcgagacaattctgcccgaattcttggacgacaaggacgaaatcgccctcgtcaattcttttaacggcttcacgacggcgttcacggggttcttcgacaacagggagaacatgttcagcgaggaagcaaaatcgacatctatcgctttccggtgcatcaacgagaacctgacccgctacatctctaatatggacattttcgagaaggttgatgcgattttcgacaagcacgaggtgcaggagatcaaagaaaagatactcaactctgactacgatgtcgaagatttttttgagggtgaattcttcaacttcgtcttgacgcaggagggcatagacgtttataacgcgattatcggcggatttgtcacggagtcgggggagaagattaaggggcttaatgagtacatcaacctctacaaccagaagacaaaacagaaactccccaagttcaagccattgtataagcaagttctgtccgatcgggagtcgctctcattctacggcgaaggctacacatccgatgaggaagtcctcgaggttttcagaaacaccctcaacaagaactctgagattttttcctccatcaagaagctggagaagctcttcaagaatttcgacgaatacagcagcgcagggatctttgtgaaaaatgggccggccatttcaacgataagcaaggatatcttcggcgagtggaatgtgataagggataaatggaacgcggagtacgacgatatccacctgaagaagaaagcggtggtcaccgagaaatatgaggatgaccgccgcaagtcgtttaagaaaattggttcgttttcactcgagcagctccaagagtatgctgatgcggatctttctgtcgttgagaaattgaaagagatcatcatacagaaggtggatgagatatacaaggtctacggctcctccgagaagttgttcgatgcggacttcgtcctcgagaagagccttaagaagaacgacgcagtggtggctatcatgaaggatctccttgactcagtcaagagcttcgagaactatattaaggccttcttcggtgaaggtaaggagacaaatagggacgagtcgttttacggcgatttcgtcctggcctacgacatcctgctcaaagttgatcacatctacgacgcgattcggaattacgtgacgcagaaaccgtattccaaagacaagttcaagttgtactttcagaaccctcaatttatgggcggctgggataaagacaaggagactgattatcgggccacaatattgcggtatggctctaagtattacctggctatcatggataagaagtacgctaagtgcctccagaagatcgataaggacgatgtcaatggcaactacgagaaaatcaactataagcttctcccgggacccaacaaaatgctcccaaaagttttctttagcaaaaagtggatggcttactacaatccaagcgaggatatacagaaaatctacaagaatggaactttcaagaagggggacatgttcaatctcaatgattgccacaagctgattgactttttcaaggattcgatcagcaggtatcccaagtggtcgaacgcttatgatttcaatttcagcgagaccgagaaatacaaggacatcgcaggtttctaccgcgaagtggaggagcagggatacaaggtctccttcgagtccgcctctaagaaggaggtggataagcttgtggaagagggtaagctctacatgtttcagatctacaataaggatttcagcgacaagtcccatggtacgcccaacctgcacactatgtactttaaattgctctttgatgagaataaccacgggcaaatccggctctccggcggcgctgagcttttcatgaggcgggcttccttgaaaaaggaggaactggtggtccatccagccaactccccaatcgcgaataagaacccagacaatcctaagaagaccactacattgagctatgacgtttacaaggacaaaaggttttccgaggaccaatacgagttgcatatccctatagcgatcaacaagtgccctaaaaacatttttaagattaatacagaagttcgcgtcttgctcaagcacgacgacaacccgtacgtgatcggcatcgatcgcggagagaggaatcttctgtacatcgtggtcgtggatggaaaagggaatattgttgagcagtacagcctgaatgagatcataaacaattttaatggcatccgcataaagacggattaccactctttgctcgacaagaaggaaaaggaacgctttgaggccaggcagaactggacctccattgaaaacatcaaggaattgaaagcgggttatattagccaggtcgtccacaagatttgcgagcttgttgaaaaatacgatgccgtcatagcccttgaagatctcaactctggattcaagaattctcgcgtgaaggtggagaagcaggtctaccagaagttcgagaagatgctcatcgacaaacttaactacatggtggataagaagtcaaatccttgtgcaaccggcggcgctctgaaggggtatcaaatcactaacaagttcgagtcgttcaaatccatgagcactcaaaatggcttcatattttatattcccgcgtggctcacctctaagatcgacccctcgaccggctttgtgaacctgttgaagaccaagtatacttccattgcagactcgaaaaaatttatatcttcattcgacaggattatgtatgtccctgaagaggatcttttcgagttcgcgctcgactataaaaacttctcgaggacagatgcggattatattaagaagtggaagctgtattcctacggcaacaggattcggattttccggaacccgaagaaaaacaacgtcttcgattgggaagaagtgtgcctgacatccgcttataaagaactgttcaacaagtacggcattaactaccagcaaggagatatcagagccctgctctgtgagcagtccgacaaggccttttattcttccttcatggcactgatgtcgcttatgcttcaaatgcgcaattccatcaccggcaggaccgatgtcgactttttgatctcacctgtcaagaactccgacgggatattctatgacagccggaactatgaggcccaagaaaatgcgatactcccaaaaaatgcggacgccaatggcgcttataatattgcgcgcaaggtcctctgggcaatcgggcaatttaagaaggccgaggacgaaaagcttgataaggtgaagattgcaatttccaacaaagagtggctcgagtatgctcaaacatcagtgaaacattaa

SEQ ID NO: 20 - protein, 1260 aa, Porphyromonas crevioricanis
  cpf1 (1)..(1260)
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 21 - DNA, 3783 bp, Porphyromonas crevioricanis
  cpf1 (1)..(3783)
atggatagtttgaaagatttcaccaatctgtaccctgtcagtaagacattgagatttgaattaaagcccgttggaaagactttagaaaatatcgagaaagcaggtattttgaaagaggatgagcatcgtgcagaaagttatcggagggtgaagaaaataattgatacttatcataaggtatttatcgattcttctcttgaaaatatggctaaaatgggtattgagaatgaaataaaagcaatgctccaaagtttctgcgaattgtataaaaaagatcatcgcactgagggtgaagacaaggcattagataaaattcgagcagtacttcgtggcctgattgttggggctttcactggtgtttgcggaagacgggaaaatacagtccaaaacgagaagtacgagagtttgttcaaagaaaagttgataaaagaaattttacctgattttgtgctctctactgaggctgaaagcttgcctttctctgttgaagaagctacgaggtcactgaaggagtttgatagctttacatcctactttgctggtttttacgagaatagaaagaatatatactcgacgaaacctcaatccactgccattgcttatcgtcttattcatgagaacttgccgaagttcattgataatattcttgtttttcagaagatcaaagagcctatagccaaagagctggaacatattcgtgcggacttttctgccgggggatacataaaaaaggatgagagattggaggatattttttcgttgaactattatatccacgtgttatctcaggctgggatcgaaaaatataacgcattgattgggaagattgtgacagaaggagatggagagatgaaagggctcaatgaacacatcaacctttacaaccaacaaagaggcagagaggatcggctccctctttttaggcctctttataaacagatattgagtgacagagagcaattatcatacttgcctgagagttttgaaaaagatgaggagctcctcagggctctaaaagagttctatgatcatatcgcagaagacattctcggacgtactcaacagttgatgacttctatttcagaatatgatttgtctcggatatacgtaaggaacgatagccaattgactgatatatcaaaaaaaatgttgggagattggaatgctatctacatggctagagaacgagcatatgaccacgagcaggctcccaaaagaatcacggcgaaatacgagagggacaggattaaagctcttaaaggagaagagagtataagtctggcaaatcttaatagttgtattgcctttctggacaatgttagagattgccgtgtagatacttatctttccacactgggccagaaggaaggaccacatggtctatctaatctcgttgagaacgtttttgcctcataccatgaagcagagcaattgttgagctttccataccccgaagagaataatctgattcaggacaaggacaatgtggtgttaattaagaatcttctcgacaatatcagtgatctgcagaggttcttgaaacctctttggggtatgggagacgaacccgataaagatgaaagattttatggagagtataattatatccgaggagctctagatcaggtgatccctctgtacaataaggtaaggaactacctcactcggaagccttattcgaccagaaaagtaaaactcaattttgggaattctcaattgcttagtggttgggatagaaataaggaaaaggataatagctgtgtgattttgcgtaaggggcagaacttctatttggctattatgaacaataggcacaaaagaagtttcgaaaacaagatgttgcccgagtataaggagggagaaccttacttcgaaaagatggattataaatttttgcctgatcctaataaaatgcttcctaaggtttttctttcgaaaaaaggaatagagatatacaaaccaagtccgaagcttttagaacaatatggacatggaactcacaaaaagggagatacctttagtatggatgatttgcacgaactgatcgatttcttcaaacactcaatcgaggctcatgaagattggaagcaattcggattcaaattttctgatacggctacttatgagaatgtatctagtttctatagagaagttgaggatcaggggtataagctctctttccgaaaagtttcggaatcttatgtctattcattaatagatcaaggcaagttgtatttatttcagatatacaacaaggacttttctccctgcagcaaagggacacctaatctgcataccttgtattggagaatgctttttgacgagcgcaatttggcagatgtcatatacaaactggatgggaaggctgaaatctttttccgggagaagagtttgaaaaatgatcatcccacgcatccggctggtaagcctatcaaaaagaaaagtcgacaaaaaaaaggagaggagagtctgtttgagtatgatttagtcaaggataggcgctatacgatggataagttccagtttcatgtgcctattactatgaattttaaatgttctgcaggaagcaaagtcaatgatatggttaatgctcatattcgagaggcaaaggatatgcatgtcattggaattgatcgtggagaacgcaatctgctgtatatatgcgtgatagatagtcgagggacgattttggatcaaatttctctgaatacgattaacgatatagactatcatgatttattggagagtcgagacaaagaccgtcagcaggagcaccgaaactggcaaactatcgaagggatcaaggagctaaaacaaggctaccttagtcaggcggttcatcggatagccgaactgatggtggcttataaggctgtagttgctttggaggatttgaatatggggttcaaacgtgggcggcagaaagtagaaagttctgtttatcagcagtttgagaaacagctgatagataagctcaactatcttgtggacaagaagaaacggcctgaagatattggaggattgttgagagcctatcaatttacggccccatttaagagttttaaggaaatgggaaagcaaaacggcttcttgttttatatcccggcttggaacacgagcaacatagatccgactactggatttgttaatttatttcatgttcagtatgaaaatgtagataaagcgaagagcttctttcaaaagtttgattcaattagttacaacccgaagaaagactggtttgagtttgcattcgattataaaaactttactaaaaaggctgaaggaagtcgttctatgtggatattatgcacacatggttcccgaataaagaattttagaaattcccagaagaatggtcaatgggattccgaagaattcgccttgacggaggcttttaagtctctttttgtgcgatatgagatagattataccgctgatttgaaaacagctattgtggacgaaaagcaaaaagacttcttcgtggatcttctgaagctattcaaattgacagtacagatgcgcaacagctggaaagagaaggatttggattatctaatctctcctgtagcaggggctgatggccgtttcttcgatacaagagagggaaataaaagtctgcctaaggatgcagatgccaatggagcttataatattgccctaaaaggactttgggctctacgccagattcggcaaacttcagaaggcggtaaactcaaattggcgatttccaataaggaatggctacagtttgtgcaagagagatcttacgagaaagactga

SEQ ID NO: 22 - DNA, 3783 bp, Porphyromonas crevioricanis
  cpf1 (1)..(3783)
atggattctttgaaggatttcacaaacctctatcctgtcagcaaaaccctgcgcttcgaacttaagccggttggcaagacgcttgaaaacatcgagaaagcgggcatcttgaaggaggacgagcacagagcagaatcgtacagacgcgtcaagaagattatagatacgtatcataaggttttcatcgatagctccctggagaacatggccaagatgggcatcgaaaacgaaatcaaggctatgttgcaatctttctgtgaactctataagaaggaccacaggactgagggcgaagacaaggccctggacaaaatcagggccgttcttcgcggtctgattgtcggcgcattcacaggtgtttgtgggaggcgggaaaataccgttcagaacgagaagtacgagtctctctttaaggaaaagttgataaaagagatcctccccgacttcgtgctcagcacagaggcggagtctctccccttctcagtggaggaagctacgaggtcgcttaaggagttcgactcctttacttcgtatttcgctggattttatgagaatagaaaaaacatttatagcactaagccgcagtcaaccgccattgcgtacagacttatacacgaaaatttgcccaaattcatcgacaatattctggtgttccagaagattaaggagcctatcgctaaggaactcgaacacatcagagctgacttctcggcaggcgggtacataaaaaaggacgagagacttgaggacatcttctccctcaactactacatccacgttctctcacaagcgggcatcgagaagtataatgcactcattggtaaaatagtgacagagggtgacggagagatgaaaggtctcaacgaacatataaacctgtataatcagcagaggggaagggaagatagacttcccctttttaggcctttgtataaacaaattttgtccgaccgggagcaattgtcatacctgccggagtccttcgagaaggatgaggaactcctgagggctttgaaggagttttacgaccacattgccgaagatattttggggagaactcaacagctcatgacatcaatctctgagtacgatcttagcagaatttatgtgaggaacgactcacagctcactgatatctccaagaagatgctcggagattggaacgctatttatatggctcgggagcgggcttatgatcatgagcaggcccccaaaaggattacggctaagtatgagagggatagaattaaggcgcttaagggcgaggaatccatttcgctggccaatctgaactcatgtatagcctttcttgataacgtccgcgattgcagagttgatacatacttgtcaacacttggtcagaaggagggcccccacggtctctctaaccttgtggagaatgtcttcgcatcctaccatgaggccgaacaattgctttctttcccctacccagaggagaacaaccttattcaagataaagataatgtcgtcctgatcaaaaaccttctggacaacatctccgaccttcagagatttcttaaacctctgtggggaatgggtgatgagccagataaggatgagcggttctatggagagtacaactacattcggggtgcacttgaccaggtgatacctctgtacaacaaagtccggaactatctcacaagaaagccctattcgactcggaaggtgaagctgaatttcggcaatagccagctgttgtccggatgggatcgcaataaggagaaggataattcctgcgttatactccggaaaggacaaaacttctacttggcaatcatgaacaatcggcataagcgcagcttcgagaataagatgcttccagaatataaggagggtgaaccttattttgagaagatggattataagttcctgcccgatcctaacaagatgcttccaaaggtcttcctgtcgaagaaaggcatagaaatctataagcccagccccaagctgcttgagcagtatggccacggcacccataagaagggggatacgttttccatggatgacctgcatgaacttatagacttctttaagcattctattgaggctcatgaggattggaagcaatttgggttcaagttttctgacactgcaacatacgagaatgtctcttcattctacagggaggttgaggaccaaggatataaactgtctttccggaaggtgtccgagtcatacgtttacagcctgatcgatcagggcaagctctacctgttccaaatatacaataaggatttctctccttgttccaaaggtactcccaacctccacaccttgtactggcgcatgttgtttgatgaaaggaatctcgccgacgtcatttacaaactcgatggtaaggccgagatcttctttagagaaaaatcactgaagaacgaccatcctacgcatccagcggggaagcccatcaagaaaaaatccaggcagaagaagggcgaagagagcctctttgaatacgaccttgtgaaggacaggcgctatactatggataagtttcaatttcatgtgcccatcactatgaatttcaagtgctcagcagggtccaaagtcaacgatatggttaacgcacatatccgcgaagctaaggacatgcacgtgattggtattgatagaggagagcgcaatcttctgtacatatgcgtgatcgatagcagggggactatccttgaccaaatttctttgaacacaattaatgacatagattaccacgaccttcttgaaagccgcgataaggacaggcaacaggagcacaggaactggcagaccattgagggcatcaaagagttgaaacagggatatcttagccaagcagtgcacagaatcgccgaactcatggtggcgtacaaagcagtggtggccctcgaggaccttaacatgggcttcaagcgggggcggcagaaggtcgaatcttccgtctaccagcagttcgaaaagcaactgattgataagcttaattacctggtggacaagaagaagaggccggaggacataggcggtcttttgcgggcataccaattcaccgcacctttcaagagcttcaaagaaatggggaaacaaaacgggttcttgttctatattcctgcgtggaacactagcaatatcgaccccactactggcttcgttaaccttttccatgtgcaatacgaaaacgtcgataaggcaaagtcctttttccagaagttcgactctattagctacaaccctaagaaagactggttcgagtttgccttcgactacaagaatttcacaaagaaggccgagggctcgagaagcatgtggatattgtgcactcacggttcgcgcatcaaaaactttcgcaactcacagaaaaacggccaatgggattctgaggaatttgctctcacggaggcatttaagtcgctgttcgtgaggtacgagatcgattacacggccgatttgaagactgcaatcgttgacgagaagcaaaaggacttctttgttgatcttctcaaattgttcaagttgacagtgcagatgaggaactcttggaaagagaaagacctcgattaccttatttcgcctgtcgcgggcgccgatggaagatttttcgatacgagggaaggtaataagtctctgccaaaggatgcagatgcgaatggtgcttacaacatcgccctgaagggtctttgggctctccggcagattcggcagacctccgagggcggaaaacttaagttggcgatttccaacaaggagtggttgcaatttgtgcaagagaggtcatacgagaaggactaa

SEQ ID NO: 23 - protein, 1323 aa, Prevotella disiens
  cpf1 (1)..(1323)
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 24 - DNA, 3972 bp, Prevotella disiens
  cpf1 (1)..(3972)
atggaaaattaccaagaatttaccaatttatttcagttgaataaaacattaagatttgagttaaagccaataggcaaaacttgtgaactccttgaagagggaaagatatttgcttctggaagttttcttgaaaaggacaaagtgcgtgcagataatgtttcgtatgtaaagaaggagattgataagaaacacaagatttttatcgaagagaccttgtcttctttttctatatctaatgatttattaaagcaatattttgattgctataatgaattgaaagcattcaaaaaagattgtaaaagtgatgaagaagaagtaaagaaaactgcgttaagaaataaatgtacttctattcagagagctatgcgtgaagctattagtcaagcatttctgaagagccctcaaaagaaattattagcaataaaaaatttaatcgaaaatgtttttaaagctgatgagaatgttcagcacttttctgaatttacttcatattttagcggatttgaaacaaatagagaaaatttctattctgatgaagaaaaatctacttctattgcttatcgtttggtacacgataaccttccaatctttataaaaaatatatacatatttgaaaaactcaaagagcagtttgatgcaaaaactttatcggagatatttgaaaattacaaattgtatgttgctggctcatctttggacgaagtcttttcgttagagtatttcaataatactctaactcagaaggggatagataattacaatgctgtgataggtaaaattgtaaaggaggataagcaagaaatacaaggactgaatgagcatattaatttgtataatcaaaaacataaagatagacgactgccattctttatttctttaaagaagcaaatattgagcgatagagaagctttgtcttggttgcccgatatgttcaaaaatgatagcgaagtaattaaggctcttaaagggttttatattgaagatgggtttgagaataatgttttaaccccattggcaactttattgagttctcttgacaagtataacctgaatggtatttttatcagaaataacgaagcgttgtcttccttgtcgcaaaatgtttatagaaactttagtatcgatgaagcgatagatgcaaatgcagaattgcaaacatttaataattatgagctaatagcaaacgcattacgtgcaaagatcaagaaagaaactaagcaaggaaggaaaagtttcgagaagtatgaagaatatatagataagaaagttaaagcaatagatagcctgagtatccaagaaataaacgaattggttgaaaattacgtatctgaatttaatagcaactcaggtaatatgcctcgaaaggtggaagactatttctcgttaatgcgaaaaggcgattttggtagtaacgacttaatagaaaatattaagacgaaactatcagctgcagagaaattgttaggtactaagtatcaagaaaccgctaaagacatatttaaaaaggacgaaaactctaaactcatcaaagagttgcttgatgctactaagcaatttcaacactttataaagccattattaggaacaggtgaggaggctgatagagatttagtcttttatggtgatttcttacccctttacgaaaagtttgaggaacttactttattgtataataaagtgagaaataggcttacccaaaagccatattcgaaagacaagataagattatgttttaataagcctaaacttatgacaggctgggtagatagtaaaacagagaaatcggataatggaacacaatacggaggctatctttttcgcaagaaaaatgaaattggcgagtatgattattttttaggtatatcttctaaagcgcaactgtttagaaaaaatgaagctgttattggtgattatgagcgattagactactatcaacctaaagccaacaccatttatggaagtgcttatgaaggagaaaatagttataaagaagacaaaaagcggcttaacaaagtcattatagcatatatagaacaaataaaacagacaaatataaaaaaatcaataatcgaaagcatcagcaaatatcctaatatctcagatgatgataaagtaactcctagttccttattggagaaaatcaagaaagtaagtatcgatagttataatggcatactaagttttaagagtttccaaagcgtaaataaggaggttattgataatttgcttaaaactatctcacccctgaaaaataaagcagagttcctcgacttaatcaataaagattatcaaatctttaccgaggttcaggctgttattgatgaaatttgtaagcaaaaaacatttatctatttccctatttcaaacgtagagttagaaaaggaaatgggagataaggataagcctttgtgtctcttccaaatatccaacaaggatttgtcttttgctaaaaccttttcggcaaatctgcgtaaaaagcgaggtgctgagaacttacatacgatgctttttaaagcacttatggagggcaatcaagataatttagatttaggctcgggagctatattctatagagcaaaaagtttagatggaaacaagcctactcaccctgcaaatgaagctataaaatgtaggaatgttgcaaacaaagacaaagtaagcctattcacctatgatatttataaaaataggagatatatggaaaataagtttttgttccatctttctattgtccaaaattataaagcagcaaatgactctgcacagttaaactcttcagccactgaatatattcgcaaagctgacgacctccacatcattggtatagaccgtggcgaacgcaatttgctttattattcggttattgatatgaagggaaatatcgttgagcaagactctttgaatattattcggaataatgatttagaaactgattatcacgacttattggataaaagagaaaaggagagaaaagcaaacagacaaaattgggaagcagtagaaggtataaaggacttgaagaaagggtatctaagtcaagcagtacatcagatagcacaactaatgctgaaatacaatgccatcatcgctttggaagaccttggacaaatgtttgttactcgaggacaaaaaatagaaaaagctgtttatcaacaatttgaaaaaagtttggtagataagctcagctatttagtagacaagaagagaccttacaacgagttaggaggaattctgaaagcatatcaactcgcttcatcgattacgaagaataatagtgataaacaaaatggcttcctattctatgtccctgcatggaatacaagcaaaatagaccctgtaacaggatttaccgacttgttgcgccctaaggcaatgacgataaaggaagcacaagatttttttggagcatttgacaatattagctataacgacaaaggttattttgaatttgaaaccaactatgacaagtttaaaatacgaatgaagagtgcgcagacacgttggactatctgtacatttggaaatcgtattaagcgtaagaaagataagaactattggaactatgaagaagtggaattgacagaagaatttaaaaagctttttaaggattccaatattgactatgagaattgcaatttgaaagaagaaatacagaataaagataatagaaaattctttgatgacttaataaagttgctacaattgacattgcagatgcgtaacagtgatgacaagggcaatgattacatcatctctcctgttgcaaatgccgaagggcaattctttgatagcaggaatggtgataaaaaattgccacttgatgccgatgccaatggggcgtacaacattgccagaaaaggtttgtggaacatcagacaaatcaagcaaactaagaatgataaaaaacttaatttatcaatatcttccacagagtggctcgattttgttcgcgagaaaccatatttgaaataa

SEQ ID NO: 25 - DNA, 3972 bp, Prevotella disiens
  cpf1 (1)..(3972)
atggagaattaccaggagtttacgaacctcttccagctcaacaagacactcaggtttgaattgaagccaataggtaaaacttgtgaactcctggaggagggaaagatttttgccagcggatcgttccttgagaaggacaaggtcagagccgataacgtctcctacgtcaagaaggaaatagacaagaagcacaaaatcttcattgaggagacacttagctcctttagcatatctaacgacttgcttaaacaatatttcgactgctacaatgagctgaaggccttcaagaaagattgtaagtcagacgaggaggaggtcaagaagaccgcgctgaggaacaaatgtacgagcatccagcgcgcgatgcgggaggctatctcacaggctttccttaaatccccgcagaaaaaactcttggctattaaaaacctcattgagaatgttttcaaggctgatgaaaacgtccaacatttttccgagttcacgtcgtatttctctggattcgagacaaatagagagaatttctattctgacgaggagaagagcacctctattgcatataggctcgtgcatgataacctcccaatatttattaaaaatatttatattttcgaaaagctgaaagagcagttcgacgctaagactctgtcagagatcttcgagaattataagttgtacgtcgccggctcctctttggacgaagtgttctctcttgagtatttcaacaacactctcacacagaagggcatcgataattataacgctgtgataggaaagatcgttaaggaggataagcaggagattcagggtctgaacgagcacattaatctgtacaatcagaagcacaaggacaggcggttgccattcttcatctcacttaagaagcaaatcttgtcagaccgggaagccctgtcctggttgcctgacatgttcaagaacgacagcgaggtgataaaggctcttaaaggcttctatattgaggacgggttcgaaaataatgtgttgaccccccttgccacccttctgtcctccttggataagtacaaccttaatggaatcttcatccggaataatgaggcattgtcgtccctttctcagaacgtctacaggaacttttctattgacgaggcgattgatgctaatgccgagctgcagacattcaacaactacgaacttatcgccaacgctcttagagcgaagatcaagaaagaaacgaagcaaggccgcaagtcattcgagaaatatgaggaatacattgacaaaaaggttaaggcaatagactctctgtctattcaggagatcaacgagcttgtggagaattatgtttccgaatttaactctaattcgggtaacatgccaagaaaagtggaagattatttcagccttatgcggaagggggatttcggctcgaacgatcttatcgagaatattaagactaaactgtcagctgctgaaaagctcttgggcaccaagtatcaggaaacggcgaaggatatcttcaaaaaggatgaaaactccaaactgattaaggagctgctcgatgctaccaagcagttccaacactttataaaacctttgctgggcactggggaggaggcggacagggatctcgtcttttacggcgacttccttccgctttacgagaagttcgaggaactgacgcttctctataataaggttcggaacagacttacccagaagccctactcgaaggacaagatcaggctgtgctttaacaaaccgaagctcatgaccggatgggtggactcaaaaacggagaagtcggataacgggacgcaatacggcggctatctttttagaaaaaagaatgaaatcggggagtatgattacttcctcggcatatcttccaaggcacagctctttagaaaaaacgaagcggtcatcggcgactatgaacgcctcgattattaccaaccaaaagccaacaccatctacgggtctgcatacgagggcgagaactcatacaaagaggataagaagaggctgaacaaggtcatcatcgcatacatagaacagatcaagcaaacaaacataaagaaatcaatcatcgagtcaattagcaagtacccaaatatctcggacgatgacaaagttacgccctcatccctgctcgaaaaaatcaaaaaggtttcaattgactcatacaatggcattctctctttcaaatcattccaatctgtgaataaggaggtgattgacaatttgttgaagacaatcagccctcttaagaacaaagcagagtttctggatctgatcaacaaggactatcagatttttacagaggtccaggcggtgatcgacgaaatttgcaaacagaaaacttttatctatttccccatctctaacgtcgagcttgagaaggaaatgggcgacaaagataagcccctctgcttgtttcaaatctctaacaaggatctgtcttttgcaaagacattcagcgcaaacctccggaagaagcgcggggctgagaatttgcatacgatgctttttaaagctttgatggaaggcaaccaggataatctcgatctgggcagcggtgccattttttatagggccaagtcactggatggcaataagcccacccaccccgcgaacgaggccattaagtgccgcaacgtcgcgaataaggacaaggtttccctctttacttacgatatttataagaacaggagatatatggagaacaagttcctgtttcatctcagcatagttcaaaactacaaggcggcaaacgactctgcccagctgaattcatcggctacagaatacatcaggaaggccgatgacctgcacatcatcggtatcgaccgcggcgagcggaatctgctctactattccgttatagacatgaaaggtaacatcgtggagcaggacagcctgaatattattcgcaataacgacctcgagaccgattatcatgacctgctcgacaagcgggagaaagagcggaaggctaataggcaaaactgggaggctgttgagggcattaaggacctgaagaaaggttatttgtcacaagctgtgcaccagatagcccaactgatgcttaaatacaatgctattatcgcgctggaagatcttggccagatgttcgtcactagaggtcagaagatcgagaaggctgtctatcagcagttcgagaagtcactcgtggataaactcagctacctcgtggataaaaagaggccttacaatgaacttggtggtattcttaaggcataccagctcgctagctccataacaaagaataattctgataagcagaacggcttcctcttttatgtgcctgcttggaatacatccaagatcgacccagtgacgggatttactgacctcctccggccgaaggccatgacaatcaaggaggcccaggatttttttggcgcctttgacaatatcagctacaacgacaaaggctacttcgaatttgagaccaattacgataagttcaagatcaggatgaagtcggcccagactaggtggacgatctgtactttcggtaatcgcatcaagcggaagaaagacaaaaattactggaactatgaagaagtcgaactgacggaagaattcaagaagttgtttaaagactccaacatcgactacgagaactgcaacctgaaggaagagatccagaacaaggataatcgcaagtttttcgacgatcttattaaactccttcagcttacgctgcagatgcgcaattcagacgacaaggggaacgactacattataagcccagtcgccaatgctgagggacaattcttcgactccaggaacggcgacaagaagctcccgcttgatgccgacgctaacggcgcctacaatatagcaaggaaaggtctgtggaacataagacaaattaagcagacgaagaacgataaaaaacttaacttgtctatttcatcgacggagtggctggatttcgttagagagaagccttacctgaagtga

SEQ ID NO: 26 - protein, 1300 aa, Francisella tularensis subsp. novicida U112
  deactivated Cpf1 (D917A) (1)..(1300)
  D917A (917)..(917)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 27 - protein, 1300 aa, Francisella tularensis subsp. novicida U112
  deactivated Cpf1 (E1006A) (1)..(1300)
  E1006A (1006)..(1006)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 28 - protein, 1307 aa, Acidaminococcus sp. BV3L6
  deactivated Cpf1 (D908A) (1)..(1307)
  D908A (908)..(908)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 29 - protein, 1307 aa, Acidaminococcus sp. BV3L6
  deactivated Cpf1 (E993A) (1)..(1307)
  E993A (993)..(993)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 30 - protein, 1206 aa, Lachnospiraceae bacterium MA2020
  deactivated Cpf1 (D815A) (1)..(1206)
  D815A (815)..(815)
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIARGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 31 - protein, 1206 aa, Lachnospiraceae bacterium MA2020
  deactivated Cpf1 (E906A) (1)..(1206)
  E906A (906)..(906)
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLADLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 32 - protein, 1238 aa, Candidatus Methanoplasma termitum
  deactivated Cpf1 (D859A) (1)..(1238)
  D859A (859)..(859)
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIARGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 33 - protein, 1238 aa, Candidatus Methanoplasma termitum
  deactivated Cpf1 (E944A) (1)..(1238)
  E944A (944)..(944)
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMAELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 34 - protein, 1373 aa, Moraxella bovoculi 237
  deactivated Cpf1 (D986A) (1)..(1373)
  D986A (986)..(986)
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIARGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 35 - protein, 1373 aa, Moraxella bovoculi 237
  deactivated Cpf1 (E1080A) (1)..(1373)
  E1080A (1080)..(1080)
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLADLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 36 - protein, 1228 aa, Lachnospiraceae bacterium ND2006
  deactivated Cpf1 (D832A) (1)..(1228)
  D832A (832)..(832)
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 37 - protein, 1228 aa, Lachnospiraceae bacterium ND2006
  deactivated Cpf1 (E925A) (1)..(1228)
  E925A (925)..(925)
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 38 - protein, 1260 aa, Porphyromonas crevioricanis
  deactivated Cpf1 (D878A) (1)..(1260)
  D878A (878)..(878)
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIARGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 39 - protein, 1260 aa, Porphyromonas crevioricanis
  deactivated Cpf1 (E963A) (1)..(1260)
  E963A (963)..(963)
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALADLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 40 - protein, 1323 aa, Prevotella disiens
  deactivated Cpf1 (D943A) (1)..(1323)
  D943A (943)..(943)
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIARGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 41 - protein, 1323 aa, Prevotella disiens
  deactivated Cpf1 (E1032A) (1)..(1323)
  E1032A (1032)..(1032)
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALADLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 42 - DNA, 380 bp, Oryza sativa
  U3 ribosomal RNA promoter (1)..(380)
aaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggc

SEQ ID NO: 43 - DNA, 807 bp, Cauliflower Mosaic Virus
  2X CaMV 35S promoter (1)..(807)
gcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctct

SEQ ID NO: 44 - DNA, 12 bp, Oryza sativa
  U3 terminator (1)..(12)
tttttttgtttt

SEQ ID NO: 45 - DNA, 1026 bp, Escherichia coli
  hpt hygromycin b resistance gene (1)..(1026)
atgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgttcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatag

SEQ ID NO: 46 - DNA, 1993 bp, Zea mays
  Ubiquitin promoter and 5'UTR (1)..(1993)
cagcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgtta

SEQ ID NO: 47 - DNA, 43 bp, Artificial
  synthetic
  GFP-targeted gRNA for Francisella tularensis subsp. novicida U112 cpf1 (1)..(43): guide RNA targeted to GFP
aatttctactgttgtagataacatggtgagcaagggcgaggag

SEQ ID NO: 48 - DNA, 43 bp, Artificial
  synthetic
  GFP-targeted gRNA for Acidaminococcus sp. BV3L6 cpf1 (1)..(43)
aatttctactcttgtagataacatggtgagcaagggcgaggag

SEQ ID NO: 49 - DNA, 43 bp, Artificial
  synthetic
  GFP-targeted gRNA for Lachnospiraceae bacterium MA2020 cpf1 (1)..(43)
aatttctactattgtagataacatggtgagcaagggcgaggag

SEQ ID NO: 50 - DNA, 44 bp, Artificial
  synthetic
  GFP-targeted gRNA for Candidatus Methanoplasma termitum cpf1 (1)..(44)
aatctctactctttgtagataacatggtgagcaagggcgaggag

SEQ ID NO: 51 - DNA, 45 bp, Artificial
  synthetic
  GFP-targeted gRNA for Moraxella bovoculi 237 cpf1 (1)..(45)
aaatttctactgtttgtagataacatggtgagcaagggcgaggag

SEQ ID NO: 52 - DNA, 44 bp, Artificial
  synthetic
  GFP-targeted gRNA for Lachnospiraceae bacterium ND2006 cpf1 (1)..(44)
aatttctactaagtgtagataacatggtgagcaagggcgaggag

SEQ ID NO: 53 - DNA, 43 bp, Artificial
  synthetic
  GFP-targeted gRNA for Prevotella disiens cpf1 (1)..(43)
aatttctacttcggtagataacatggtgagcaagggcgaggag

SEQ ID NO: 54 - DNA, 209 bp, Cauliflower Mosaic Virus
  CaMV 35S polyA terminator (1)..(209)
gatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 55 - DNA, 720 bp, Aequorea victoria
  GFP (1)..(720)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 56 - protein, 239 aa, Aequorea victoria
  GFP (1)..(239)
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 57 - DNA, 30 bp, Artificial
  synthetic
  reverse primer to amplify pZmUbi::GFP junction (1)..(30)
gtcttgtagttgccgtcgtccttgaagaag

SEQ ID NO: 58 - DNA, 30 bp, Artificial
  synthetic
  forward primer to amplify pZmUbi::GFP junction (1)..(30)
ggatgatggcatatgcagcagctatatgtg

SEQ ID NO: 59 - DNA, 457 bp, Artificial
  synthetic
  DNA region PCR amplified by SEQ ID NOs: 57 and 58 in unedited DNA (1)..(457)
ggatgatggcatatgcagcagctatatgtggatttttttagccctgccttcatacgctatttatttgcttggtactgtttcttttgtcgatgctcaccctgttgtttggtgttacttctgcaggtttaaacatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagac

SEQ ID NO: 60 - DNA, 24 bp, Artificial
  synthetic
  forward primer to amplify GFP gene (1)..(24)
ggtgttacttctgcaggtttaaac

SEQ ID NO: 61 - DNA, 20 bp, Artificial
  synthetic
  reverse primer to amplify GFP gene (1)..(20)
ccatgaccggtccgttactt

SEQ ID NO: 62 - DNA, 455 bp, Artificial
  synthetic
  DNA region PCR amplified by SEQ ID NOs: 57 and 58 in positive-control DNA for T7EI assay (1)..(455)
ggatgggcatatgcagcagctatatgtggatttttttagccctgccttcatacgctatttatttgcttggtactgtttcttttgtcgatgctcaccctgttgtttggtgttacttctgcaggtttaaacatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagac

SEQ ID NO: 63 - protein, 1300 aa, Francisella tularensis subsp. novicida U112
  deactivated_cpf1_double_mutant (1)..(1300)
  D917A (917)..(917)
  E1006A (1006)..(1006)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 64 - protein, 1307 aa, Acidaminococcus sp. BV3L6
  deactivated_cpf1_double_mutant (1)..(1307)
  D908A (908)..(908)
  E993A (993)..(993)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIARGERNLIYITVIDSTGKILEQRSLNTIQQFDYQKKLDNREKERVAARQAWSVVGTIKDLKQGYLSQVIHEIVDLMIHYQAVVVLANLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 65 - protein, 1206 aa, Lachnospiraceae bacterium MA2020
  deactivate_cpf1_double_mutant (1)..(1206)
  D815A (815)..(815)
  E906A (906)..(906)
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIARGERNLLYVVVIDSKGNILEQISLNSIINKEYDIETDYHALLDEREGGRDKARKDWNTVENIRDLKAGYLSQVVNVVAKLVLKYNAIICLADLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 66 - protein, 1238 aa, Candidatus Methanoplasma termitum
  deactivated_cpf1_double_mutant (1)..(1238)
  D859A (859)..(859)
  E944A (944)..(944)
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIARGERNLLYYSIIDRSGKIIDQQSLNVIDGFDYREKLNQREIEMKDARQSWNAIGKIKDLKEGYLSKAVHEITKMAIQYNAIVVMAELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 67 - protein, 1373 aa, Moraxella bovoculi 237
  deactivated_cpf1_double_mutant (1)..(1373)
  D986A (986)..(986)
  E1080A (1080)..(1080)
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIARGERHLLYLTVINSKGEILEQCSLNDITTASANGTQMTTPYHKILDKREIERLNARVGWGEIETIKELKSGYLSHVVHQISQLMLKYNAIVVLADLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 68 - protein, 1228 aa, Lachnospiraceae bacterium ND2006
  deactivated_cpf1_double_mutant (1)..(1228)
  D832A (832)..(832)
  E925A (925)..(925)
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALADLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 69 - protein, 1260 aa, Porphyromonas crevioricanis
  deactivated_cpf1_double_mutant (1)..(1260)
  D878A (878)..(878)
  E963A (963)..(963)
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIARGERNLLYICVIDSRGTILDQISLNTINDIDYHDLLESRDKDRQQEHRNWQTIEGIKELKQGYLSQAVHRIAELMVAYKAVVALADLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 70 - protein, 1323 aa, Prevotella disiens
  deactivated_cpf1_double_mutant (1)..(1323)
  D943A (943)..(943)
  E1032A (1032)..(1032)
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIARGERNLLYYSVIDMKGNIVEQDSLNIIRNNDLETDYHDLLDKREKERKANRQNWEAVEGIKDLKKGYLSQAVHQIAQLMLKYNAIIALADLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 71 - DNA, 2723 bp, Oryza sativa
  CAO1_locus (1)..(2723)
agtatgtattttatattaaaaatattgctatattttctataaatttaattagactggacaagtttgacatgaataaagtcaaagcgggttataaaatgaggaagtatcgtccattccctcgttaaaaaaagcaatttgtaactatagttatgaacgagtactggtcatgtctagattttatttatagccatttcgttttgggtcgagagcagagggaatatcttgcatgtaagtaaacatagagttaaatcaaagacatttgttcagttgtaccatattcaacatacctatagctttgaagctaccgaaattcttgtagcggacagcagcaagtgccgaaaaattctacttcatccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggaggtggacggaggagggatcaacggctgagatgcgttcctgcgtgccacgtggtgcgccgcgagcagataagggttcagggcgtcgcgacggggtcgagagataaggggcgcgcggcgagtggcgcgccacgtcgcgtggcccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtcc

SEQ ID NO: 72 - DNA, 516 bp, Oryza sativa
  U6_promoter (1)..(516)
tttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagctt

SEQ ID NO: 73 - DNA, 44 bp, Artificial
  synthetic
  Fncpf1_gRNA1-rice_CAO1 (1)..(44)
gaatttctactgttgtagattggagcaacacctgaaggaaggct

SEQ ID NO: 74 - DNA, 12 bp, Oryza sativa
  U6_terminator (1)..(12)
tttttttgtttt

SEQ ID NO: 75 - DNA, 5302 bp, Artificial
  synthetic
  Rice_CAO1_hyg_donor_repair_cassette (1)..(5302): from Vector 131760
  upstream_homologous_arm (1)..(1000)
  CaMV_35S_terminator (1001)..(1243)
  hyg_resistance_ORF (1244)..(2276)
  ZmUbi_promoter (2277)..(4302)
  downstream_homologous_arm (4303)..(5302)
tccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggaggtggacggaggagggatcaacggctgagatgcgttcctgcgtgccacgtggtgcgccgcgagcagataagggttcagggcgtcgcgacggggtcgagagataaggggcgcgcggcgagtggcgcgccacgtcgcgtggcccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaaagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcct

SEQ ID NO: 76 - DNA, 1026 bp, Escherichia coli; identical to SEQ ID NO: 45
  hygromycin_resistance_gene (1)..(1026)

SEQ ID NO: 77 - protein, 341 aa, Escherichia coli
  hygromycin_resistance_protein (1)..(341)
MKKPELTATSVEKFLIEKFDSVSDLMQLSEGEESRAFSFDVGGRGYVLRVNSCADGFYKDRYVYRHFASAALPIPEVLDIGEFSESLTYCISRRSQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKK

SEQ ID NO: 78 - DNA, 19 bp, Artificial
  synthetic
  ZmUbi_primer (1)..(19): primer anneals with the ZmUbi promoter
gctgcactgcagaagcttg

SEQ ID NO: 79 - DNA, 18 bp, Artificial
  synthetic
  rice_CAO1_downstream_primer (1)..(18): primer anneals with a region of the rice genome downstream of the intended CAO1 insertion site
ttggagcaagggaagtgc

SEQ ID NO: 80 - DNA, 1320 bp, Artificial
  synthetic
  CAO1_insertion_downstream_amplicon (1)..(1320): amplicon produced from PCR with SEQ ID NOs:78 and 79 from the rice genome following introduction of the ZmUbi:hygromycin resistance gene:35S polyA cassette in the rice CAO1 genomic locus using vector 131760
  ZmUbi_promoter_fragment (1)..(22)
  downstream_homology_arm (23)..(1022)
  downstream_rice_genomic_sequence (1023)..(1320)
gctgcactgcagaagcttgctgccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaa

SEQ ID NO: 81 - DNA, 7492 bp, Artificial
  synthetic
  Vector_131272 (1)..(7492): Circular Vector
  2X35S_promoter (492)..(1271)
  Fncpf1 (1280)..(5217)
  35S_polyA (5225)..(5433)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacgtttaaacatggccccaaagaagaaacggaaggttatgtcgatataccaggaattcgtcaacaagtattctctgtcgaaaactctgcggtttgagctgatccctcaggggaagacccttgaaaacatcaaggcgcggggcctcatcctggatgacgaaaagcgcgcgaaggattataaaaaggccaagcagattatagataaataccatcaattcttcattgaggaaatcctctcatcagtttgcatatcggaagacctgttgcaaaactattccgatgtttacttcaagctgaaaaaaagcgacgatgacaatctgcaaaaagacttcaagtctgctaaagatacaatcaagaagcagatctctgaatacatcaaagactcggagaagttcaaaaatctgtttaatcagaatttgatcgacgccaagaagggccaggagtccgacctcatcctttggttgaagcagagcaaggacaatggcatcgaacttttcaaggccaatagcgatattaccgatatcgacgaggcgctcgagattattaagagcttcaagggttggacaacgtacttcaaaggattccacgagaataggaagaacgtctactcgtcaaacgacataccgacatctatcatttaccgcatcgtcgacgacaatttgcctaagttcctcgagaacaaggccaagtatgaatcgcttaaggacaaagctcctgaggcaattaactacgaacagattaaaaaggacctggccgaagaactgacctttgacatagactataaaacgtccgaggtcaatcaaagagtgttctctttggacgaagtgtttgaaattgcgaacttcaacaactacttgaatcagtccggcatcaccaaattcaacactatcataggtgggaagttcgtcaatggcgaaaacacaaagaggaaaggaatcaatgaatacatcaatctgtactcacaacagataaatgacaagaccctcaaaaagtataagatgtcagttctcttcaagcagattctctctgatacggagtccaagagcttcgtcatcgacaaactggaggacgattctgacgtggtcactacgatgcagtcgttttatgagcagatcgcagcgttcaaaaccgtcgaggaaaagagcataaaggaaaccctttctctcttgtttgacgacctgaaggcccaaaaactcgatctctccaagatatacttcaaaaatgataagtctttgactgacctctcccagcaggtcttcgacgactattccgtcatcggaacagccgtgctggagtatataacgcagcaaatcgctcctaaaaatttggacaatcctagcaagaaggaacaagagcttattgccaagaagactgaaaaagccaagtatctcagcctggaaacaattaaactggcgcttgaagagtttaataagcaccgcgacatcgacaaacaatgccgcttcgaggagattctggctaacttcgcggccatccctatgattttcgacgagattgcgcaaaacaaggataacttggcacagattagcattaagtaccagaaccaggggaagaaggaccttctgcaggcgtcagctgaggacgatgtgaaggcgatcaaagatctcttggaccagactaataatctgctccataaactgaagatttttcatatctcacagagcgaggataaggccaacatccttgacaaggacgagcatttttatttggtcttcgaagagtgctacttcgagttggcaaatattgtgccactttacaacaagataaggaattacatcacccaaaagccgtattcagatgagaaattcaagctgaacttcgagaactcaacactggccaacggctgggacaagaataaggaacctgacaacacagctatactgttcattaaggatgataaatattacctcggtgtcatgaacaaaaagaacaacaagatcttcgacgataaagctataaaggagaacaagggagagggctacaaaaagatcgtttataaattgctcccaggcgctaacaaaatgctgcccaaggtcttcttttcggccaagtcaattaagttctacaacccttcggaagatatacttagaatcaggaatcattccacccatacgaagaatggtagcccgcagaagggctacgagaaattcgagtttaacattgaagattgtaggaagttcatcgatttctataaacaatctatttctaagcatccggagtggaaagatttcggttttcggttctcagacacccagcgctacaactctatcgacgagttttatcgggaggtcgagaaccagggttacaagctcacttttgaaaacatcagcgagtcctacattgattccgtggtgaaccaaggcaaactctacttgtttcagatctacaataaggacttctcagcttactctaagggcagacctaatctccataccctgtattggaaagcgctcttcgatgaaaggaatcttcaggacgtggtttacaagcttaatggcgaggctgagctgttctataggaagcagagcatcccaaagaagataacacatccggccaaggaagcaatcgctaacaagaacaaagacaatcctaaaaaagagtcagtctttgagtacgatctgataaaagataagaggtttacagaggataaattcttcttccactgcccaattactataaatttcaagtcgtctggagctaacaagtttaacgacgagatcaaccttctcttgaaagaaaaagcaaacgacgttcacatccttagcatcgaccgcggtgagcggcaccttgcgtactacactctcgttgatggcaaaggcaacatcattaagcaggacacctttaacattataggcaacgacagaatgaaaacgaactaccacgataagttggccgccatcgaaaaggaccgcgactcagctcgcaaggattggaagaaaattaataacataaaggagatgaaagaggggtacctttcccaggtggtgcatgaaatcgctaagcttgttattgagtataacgcgattgtggtgttcgaggaccttaacttcgggttcaagcgcggtcggtttaaagtcgaaaagcaggtgtatcagaaactggagaaaatgctgattgagaagcttaactacctggttttcaaggacaatgaattcgataaaactggtggggtgcttagagcgtatcaactgacagcgccattcgagacatttaaaaagatgggtaaacagacagggattatctactatgtgcctgcaggattcacctctaaaatctgcccagtcactggcttcgtgaaccagctgtacccgaagtacgagagcgtttctaagtcccaggaattcttcagcaagttcgataagatatgctacaatttggacaaagggtacttcgagttctccttcgattacaagaactttggagataaggcggctaagggcaagtggactatcgcatcgtttggatctagactcatcaattttaggaactcagataagaatcacaactgggatacaagggaagtctaccccacgaaggagttggagaagctgctcaaggattatagcatagagtacggacacggcgagtgtataaaggccgccatttgcggagagtcggacaagaagttctttgctaagttgacatccgtgctcaatactattctgcagatgagaaactcgaagaccggcacggagctggactacctgatttctcctgtggcagatgttaatggcaacttcttcgactctcgccaggccccgaagaacatgccccaagatgctgatgcaaatggagcctaccatatcggtctcaagggcttgatgcttcttggccggattaaaaacaatcaagagggtaagaaactgaatctcgtcatcaagaacgaggagtacttcgagtttgtccaaaatagaaacaactaacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 82 - DNA, 7520 bp, Artificial
  synthetic
  Vector_131273 (1)..(7520): Circular Vector
  2X35S_promoter (492)..(1271)
  Acidaminococcus_cpf1 (1280)..(5245)
  35S_polyA (5253)..(5461)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacacacacagtttaaacatggccccaaagaagaaacggaaggttatgacccaattcgaaggcttcactaatctgtaccaggtttcaaagactcttagatttgaactgatacctcagggcaaaacactgaagcacatccaggagcagggattcatcgaggaagacaaggctcgcaacgaccactataaagaactcaaacccattatcgatcggatctacaaaacatacgcggaccagtgcttgcagcttgtccaattggactgggaaaacctgtccgccgccattgactcttacaggaaggagaagactgaggaaacgagaaacgcgcttatcgaggagcaggccacctaccggaacgcgatccacgactacttcattggtaggacagacaacctcactgatgcgattaacaagcgccacgcggaaatatataaaggcctgttcaaagctgaactgttcaacggtaaagttctgaaacagctcggcaccgtcacaacaaccgagcatgagaacgccctcttgcgctctttcgacaaattcactacttacttctccggcttctacgagaacaggaaaaacgtcttttcggcagaagacataagcaccgctatccctcacagaatcgtgcaggacaacttcccgaaattcaaagagaactgccacatattcacacgcctcattactgctgtgccgtctctcagagagcactttgagaacgtgaagaaggctattggaatctttgtgtcaacatctattgaggaggtgttctcgttccctttttacaaccagcttttgactcagactcagatcgacctctacaaccagctcctgggagggatatcccgcgaagccgggactgagaagataaagggcctcaatgaggtgttgaacctcgccatccagaaaaacgatgagaccgcacacatcatcgcgtcgctcccgcatcgcttcataccactctttaagcagatcctgtccgacagaaataccctgtcctttatccttgaggaattcaagtcggatgaggaggtgatccagtcattttgcaaatacaagacccttcttcggaacgaaaatgtgctggaaaccgccgaggctctcttcaacgagttgaactccatcgacctgactcacatcttcattagccataaaaagcttgaaaccatttcttctgcgctgtgcgatcattgggacacactgaggaacgccctctatgaacggcggatcagcgagttgactgggaaaatcacaaagtccgcgaaagagaaagtccagaggtccctcaagcatgaagatattaatctccaggagatcatctcagcagcgggcaaggagttgtccgaagcattcaagcaaaagacatcggagatccttagccatgcgcacgctgctctggaccaacccctgcctacaacccttaagaaacaggaggaaaaggaaattctcaagagccaattggactctctgctgggcctttaccatctcctggactggtttgctgtcgacgaatcgaacgaggtcgaccccgagttttcggcgagactgactgggataaaactcgaaatggagccatccctgagcttttacaacaaggccaggaattatgctaccaagaagccgtactccgttgagaaattcaagctcaacttccagatgccaactctggcatctggctgggacgtgaataaggaaaagaataatggggccattctgtttgtcaaaaatggtctctattatttgggcattatgccgaagcaaaaagggaggtacaaggcactcagctttgagcctactgaaaagacatctgagggcttcgataagatgtactacgactacttccctgatgctgcgaaaatgatacctaagtgctccactcaacttaaggcagttactgcccattttcagactcacacgacgcctatactcctgtccaacaatttcattgagcccctggagatcaccaaggagatctacgacctcaacaacccggaaaaggagccgaaaaagttccagacggcttatgccaagaaaacaggagaccaaaagggctaccgggaagccctgtgcaagtggatcgattttactcgcgatttcctctccaagtacactaagactacatcaatagatctgtctagccttcggcccagctcgcaatacaaggaccttggagagtactacgcggagctgaacccactcctttaccatatttcctttcaaagaatcgcggagaaggagataatggacgccgtcgaaaccggaaaactttatcttttccaaatttacaacaaggactttgctaaaggccaccacgggaagcctaacctccacaccctctattggactgggctcttttctcccgaaaatctcgcaaaaacctcaattaagctcaatggccaagcggagttgttctatagacctaaatcgaggatgaagagaatggctcaccgccttggggagaagatgcttaacaaaaagcttaaggatcagaaaactcccattcctgataccctgtaccaggagctttacgattacgttaaccatagactctcccatgacctgtcagatgaagcccgcgccctgctccccaacgtcattaccaaagaagtctcgcatgaaatcattaaggaccgcaggtttactagcgataaattcttcttccatgttcctatcacactgaactaccaggctgcgaactcaccatccaagttcaatcagcgcgttaatgcgtatttgaaggaacacccggagacccctatcatcgggattgacagaggggaacggaaccttatttatataacagtcattgacagcaccggcaagatcctggagcaaagaagcttgaatacaattcaacaatttgactaccagaaaaagttggacaacagggagaaagaaagggtcgccgcgaggcaagcctggtctgtggttggcaccatcaaagaccttaagcagggatacctgagccaggtgattcatgaaatcgttgatctgatgattcactaccaggctgtggtggttctcgaaaatctcaacttcggttttaagtcgaaaagaacgggcatcgcggaaaaggccgtctaccagcaattcgagaagatgctgattgataagctgaattgcctcgtcctgaaggattaccctgcggaaaaggtcggcggagtgctgaacccttaccaactgaccgatcagtttacgagctttgccaaaatggggacccagtcaggcttcctcttctacgtcccggcaccctatacatcaaagattgatccgctcactggcttcgtggatcccttcgtttggaagacaattaagaatcatgagtcccggaagcactttcttgaggggttcgatttccttcattatgacgtcaaaactggcgacttcatattgcactttaagatgaatcgcaacctctctttccaaagggggcttcccggcttcatgccagcttgggacatcgtgttcgagaagaacgaaacccaatttgatgccaagggcaccccattcattgcaggcaagcgcattgtgccagtcattgaaaatcatcgctttactggtaggtacagggacctgtaccccgccaacgagcttatcgcattgctcgaagagaagggcatcgtctttcgggatggatccaatatcctgcctaagctgctcgagaatgatgattcgcacgctatcgatacgatggtcgcgttgataaggtccgtgctgcagatgagaaattcaaatgcggccacaggcgaggattacataaatagcccggtgagagatctcaacggagtgtgttttgacagcaggttccaaaacccagaatggccgatggacgcagacgctaatggagcttaccatatagcacttaaggggcagctgctcctcaaccacctgaaagagtctaaggacctcaaactccagaacggcatctctaaccaagactggctggcctacatccaagaattgagaaactaacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 83 - DNA, 7202 bp, Artificial
  synthetic
  Vector_131274 (1)..(7202): Circular Vector
  2X35S_promoter (492)..(1271)
  Lachnospiraceae bacterium MA2020_cpf1 (1280)..(4927)
  35S_polyA (4935)..(5143)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacatggccccaaagaagaaacggaaggttatgtactacgagtcattgactaaacagtatccagtgagcaaaaccatacggaacgagcttatccctatcggcaaaactctcgacaacatacgccaaaacaacatcctggagtccgacgtgaagcggaaacagaattacgagcacgttaaaggcatccttgacgaataccataagcaacttatcaatgaggctctcgacaattgcactcttcccagcctcaaaattgctgccgagatctacctgaagaaccaaaaggaggttagcgacagagaggactttaacaagactcaggacttgttgaggaaggaagtcgtggagaaacttaaagctcatgagaacttcacaaagataggcaagaaagatattttggacctgctggaaaagcttccgtctatctcagaggacgattacaacgctcttgagtcctttaggaacttctatacgtactttacgtcatataacaaggtcagggagaacttgtattctgacaaggaaaaatcctctacggttgcttatcggctcatcaacgaaaacttccccaagttcctggacaacgtcaaatcatacaggttcgtcaaaaccgcggggattctcgcagatggcctcggtgaggaggagcaggattctctcttcatagttgagacttttaacaagacactcacccaagatggtattgacacttacaactcccaggtgggaaaaatcaactcctctataaacctctacaatcaaaagaatcagaaggccaacggattccggaagatcccgaagatgaagatgctttataagcaaattttgagcgatcgggaagagtcttttatcgatgaattccagtctgatgaggttttgatcgataacgtcgagagctatggctcagtgttgatcgagtccctcaagagcagcaaggtctcggctttctttgacgcgctccgcgaatcaaagggcaagaatgtttatgtcaagaatgatcttgccaagacggcaatgtctaatattgtcttcgagaactggcgcactttcgacgatctcttgaatcaggaatatgacctcgcgaacgagaacaaaaagaaggacgacaaatacttcgagaagaggcagaaggaactcaagaagaataagtcttactccctcgagcatctctgtaatctgtctgaggattcctgtaacttgatcgagaactacatccaccagatcagcgacgatatagagaatattattatcaataacgagaccttcctgcggattgttataaacgagcacgacaggtccagaaagttggccaagaatcgcaaggctgtcaaggccatcaaagattttctggattcaattaaggtgctcgagagagaattgaagctcataaactcctcaggccaggagctggaaaaggatctgattgtgtactcggctcatgaggagctgctcgtcgaactcaagcaggtggattctctgtataacatgactagaaactatctgaccaaaaagcctttttcaactgaaaaagtgaagttgaacttcaatcggtctacgctcctgaacgggtgggataggaacaaggaaaccgacaacctgggagtgctcctccttaaggatggcaagtactacctcggcatcatgaatacttcggccaacaaggccttcgtgaatcctccagtcgcgaagaccgaaaaggtcttcaagaaagtggactacaaattgctcccagttcccaatcaaatgctgcccaaagtgttcttcgcgaagtcgaatatagatttctataacccatccagcgagatttattcaaactacaagaaaggaacacacaaaaagggaaacatgttctctttggaggactgtcacaaccttatcgatttcttcaaggaatcaatttcaaagcacgaggattggtccaagttcggattcaagttctctgatacggcttcgtataatgatatctcagagttttacagagaggtcgaaaagcagggctacaaactgacttatacggatatcgacgagacgtacataaacgacttgatcgaaaggaatgagctttatctttttcaaatctacaacaaggatttttctatgtactcgaagggcaagctcaacctgcatactctgtattttatgatgctctttgaccagcggaacattgacgatgtggtgtacaagctgaacggagaagcagaagtgttctaccggccggcctccatttcggaggatgaactcattattcacaaggcgggggaggagattaaaaacaagaaccctaaccgcgcgaggacgaaggagacttccactttctcatatgatatcgttaaggataagaggtacagcaaagacaagtttacactccatattccgattactatgaactttggcgtggacgaggtgaagaggttcaatgacgcagtcaactcagcgattaggatcgacgagaatgtcaacgtcataggtatagacagaggagagagaaacctcctgtacgtcgtggtcatcgactccaaaggcaatatactggaacaaattagcctgaactcaatcataaacaaggagtacgacatcgaaaccgactaccacgctctcctggatgagcgggaaggcggtcgggataaagccaggaaggattggaacactgtggagaacataagagatcttaaggccggttacctctcacaggtcgttaacgtggttgcgaagttggttctcaagtacaatgccatcatttgcctcgaggacctgaatttcgggttcaaaaggggtaggcagaaggtggagaagcaagtttaccaaaagtttgagaagatgctgatcgacaagcttaattacctcgttatagacaaatcgcgggagcaaacctccccgaaagagctgggcggcgcacttaatgcacttcagctgacttcgaagttcaagtcgtttaaggaactcggcaagcaatcgggtgttatttactacgtcccagcttacttgacgtcgaaaattgaccctactactggctttgcgaacttgttctatatgaaatgcgagaacgtcgagaaaagcaagaggtttttcgatgggtttgacttcatcaggttcaacgcccttgaaaacgttttcgagtttgggtttgattacaggtccttcacacagagggcctgtggtatcaattcaaagtggactgtgtgtacaaacggcgaacgcataatcaaataccgcaatcctgacaaaaacaatatgttcgacgaaaaggttgttgtcgtgaccgacgagatgaagaacctttttgagcagtataagataccatacgaggatgggaggaatgttaaagacatgataatctccaacgaggaggccgagttttatagacgcctgtatcggctcttgcagcaaaccctccaaatgagaaattcgacctctgatggcacaagggattacatcatctccccggtcaagaacaagagggaggcctattttaattccgaactgagcgacggcagcgtcccgaaggatgcggacgccaatggagcgtataacatcgctaggaaaggcctttgggttctcgagcaaataaggcaaaagagcgagggggagaaaatcaacctggcgatgacaaatgcggagtggttggagtatgctcaaacacatctcctgtagcggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 84 - DNA, 7298 bp, Artificial
  synthetic
  Vector_131275 (1)..(7298): Circular Vector
  2X35S_promoter (492)..(1271)
  Candidatus Methanoplasma termitum_cpf1 (1280)..(5023)
  35S_polyA (5031)..(5239)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacatggccccaaagaagaaacggaaggttatgaacaattatgacgaatttacaaagctttacccaatacagaagaccatacgcttcgagctgaaaccccagggccggaccatggaacacctcgagacattcaacttttttgaggaggatcgggaccgggccgagaaatataagattttgaaagaggcgattgatgaataccataagaaatttatcgacgagcacctcaccaacatgagcctcgattggaacagccttaagcagatttcggagaaatactataagtctagggaagaaaaggataaaaaagtcttcctttccgagcagaaacggatgcgccaggagatagtgtcagagttcaagaaggatgatcggttcaaggacctgttctccaagaagctcttctccgaactcctgaaggaagagatttacaaaaaggggaaccatcaggagatagacgccctcaagtccttcgacaaattctctggttacttcattggattgcacgagaatcggaaaaatatgtattcagacggggacgagattacagcgatatctaacagaatcgtcaatgagaattttccgaagttccttgataatctgcagaagtaccaggaggcgcggaaaaaatatcccgaatggataatcaaggctgagtccgccctggtcgcacacaacattaaaatggatgaggttttttctctggagtactttaacaaggtgctcaatcaagaaggaatacagcgctacaacctggcgctcggaggctatgtcaccaaatctggggagaagatgatgggactgaacgatgccctgaatttggctcaccagtccgaaaaatcgagcaaaggcaggatacacatgacacctcttttcaaacagattttgagcgagaaggagtcattctcttacatccccgatgtgttcacagaggactcccaactccttccttctatcggtggcttctttgcccaaatcgagaatgataaagatgggaatattttcgatagggcgcttgaactcatctcgagctacgctgagtacgataccgagcgcatctacatcagacaagccgacataaaccgcgtcagcaatgttatctttggagaatgggggaccctgggtgggctcatgcgcgaatacaaagctgactccataaatgacatcaacctcgagcgcacctgcaagaaagtcgacaagtggctcgacagcaaggagtttgcccttagcgatgtgttggaggcaataaaaagaacagggaataatgatgcatttaacgagtatatttcgaaaatgcggacagccagagagaaaattgatgcggcacggaaagaaatgaaattcatttctgaaaaaatatctggggatgaggagtcaatccacattatcaagacccttctggattcggtgcaacagttcttgcatttcttcaacctgtttaaggccaggcaagacattcctcttgatggtgccttttatgcagagttcgacgaggtccactctaagctgttcgccattgttccactttacaacaaggtgaggaactacttgaccaaaaataacctgaacaccaaaaagataaaacttaattttaagaacccaacacttgccaatggctgggaccagaataaggtgtacgattatgcgtcgctgatctttcttcgcgacggtaattactatcttggaataataaatcctaagaggaaaaagaacattaaattcgaacaaggctcaggcaacggcccgttttatcgcaagatggtctataaacaaatccccggccccaacaagaaccttccaagggtttttttgaccagcacaaaggggaaaaaagagtacaagccaagcaaggagataatcgagggttatgaggctgacaagcacataaggggcgacaagtttgatctcgacttttgtcacaaactgatagatttcttcaaggagtccatagagaaacataaggactggtcgaaattcaatttttatttctcccccactgagagctatggcgacatctcggagttttacctcgatgtggagaaacaggggtacaggatgcatttcgaaaatatctccgcagagaccatcgatgagtacgtggagaagggtgaccttttcctgttccagatttacaacaaggatttcgttaaggcagcaacaggaaagaaggacatgcacacgatatattggaatgcagctttctcccccgagaacctgcaagacgtggttgtcaagctgaatggcgaggccgagctgttttatcgcgataagtccgacattaaggaaattgtgcatcgcgagggcgagatcctcgttaatagaacctataacggcaggacccctgtgcctgacaaaatccataagaaattaacagactaccacaacggccgcacgaaggacttgggtgaggcgaaggaatacttggataaggtccgctacttcaaagcgcactatgacatcacaaaggataggaggtatctcaacgataaaatatacttccacgtccctcttacacttaatttcaaagcgaatggaaagaaaaaccttaataagatggtgatcgaaaagttcctgtccgatgagaaagctcatataattgggatcgatcggggggagagaaacctcctctactattctataattgacaggtccggcaaaataatcgatcaacagtctcttaatgttatcgacggattcgactaccgcgaaaagttgaaccagcgcgagatcgagatgaaggatgcgaggcaatcatggaatgctattggcaagatcaaggacttgaaggagggatacctctcgaaagcggtgcacgaaattaccaagatggcgattcaatacaatgctatcgtcgtgatggaggagttgaattatggattcaagaggggcaggttcaaggttgaaaagcagatataccaaaagtttgaaaacatgttgattgataaaatgaactacttggtttttaaggacgcccccgatgaaagtcctggtggtgtgcttaatgcataccagctcaccaacccattggagtcgttcgcgaagttgggcaagcagacgggtatcttgttctacgtgcccgccgcatatacatccaagattgaccctaccacgggatttgtcaacttgttcaacacttcatccaagactaatgcgcaggagagaaaggagtttcttcagaaattcgaatcgatctcctacagcgcgaaggacggcgggatatttgccttcgcgtttgactacagaaagttcggaacttccaagaccgatcacaagaacgtgtggaccgcctacaccaatggcgaaaggatgcgctacataaaagagaaaaaaagaaatgagctgttcgatccctcgaaagagattaaggaagctttgacttcgtcaggaatcaaatacgacggtggacaaaatatactcccggacatcttgaggagcaacaacaacggtctgatatatacaatgtacagctcctttattgctgctattcaaatgcgcgtctacgacgggaaggaggactacataatatctccaattaagaactctaaaggagagtttttccgcacagatcctaagagaagagaacttcctattgacgcggatgccaatggggcgtacaacatagcgcttcgcggcgaactgaccatgagagccatagccgaaaaattcgacccagatagcgaaaaaatggcgaagttggagttgaagcacaaggattggttcgagtttatgcaaacaagaggagattgacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 85 - DNA, 7718 bp, Artificial
  synthetic
  Vector_131276 (1)..(7718): Circular Vector
  2X_35S_promoter (492)..(1271)
  Moraxella bovoculi_cpf1 (1280)..(5443)
  35S_polyA (5451)..(5659)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacacacacagtttaaacatggccccaaagaagaaacggaaggttatgctgtttcaggattttacgcatctgtatcccctctcgaagaccgtgagattcgaacttaagcctatcgacaggactctggagcatatccacgctaaaaactttctctcgcaagacgagactatggccgatatgcatcaaaaggttaaggtgatcttggatgactatcacagggactttattgccgacatgatgggtgaggtgaagctgacgaagctcgcagagttttacgatgtctacctcaagttcaggaagaatccgaaagatgatgaactccagaagcagttgaaggatctgcaggctgttctccggaaggaaatcgtgaaacccattggaaacggtggcaagtataaggcagggtatgatagactttttggagcgaagctcttcaaggatggtaaggagcttggcgatctcgccaagttcgttatcgcccaagaaggtgaatcgtcccctaaactggcgcaccttgcacatttcgagaaattctccacatattttacgggcttccacgataatagaaaaaatatgtattcggatgaagacaagcataccgctattgcataccgcctgatacacgagaacctgccccgctttatcgacaaccttcaaattcttaccaccattaagcagaagcacagcgcgctctacgaccagattatcaatgagctgaccgcgagcggtctggacgtctccctcgcctcgcacctcgatggctaccataaattgttgactcaggagggtattacggcttataatacgctgttggggggtatctccggagaggcaggcagccccaaaattcagggtataaatgagttgatcaattcgcatcacaatcaacactgccacaagtctgaacgcatcgccaagctccgccctctgcataaacagattttgtcggacgggatgtcagtttctttcttgccgagcaagtttgccgatgactctgaaatgtgccaggccgtgaatgagttttataggcattatgcagacgtcttcgcaaaggttcaatccctttttgatggcttcgatgatcaccaaaaggacggcatctacgttgaacacaagaatcttaatgagctgtccaaacaagccttcggcgactttgctctcttgggaagagtgcttgatggctactatgtggatgttgtgaatccggagtttaatgagaggttcgctaaagcgaaaactgacaatgcaaaagccaagcttaccaaggaaaaggacaagtttatcaaaggggttcattctctcgcatcgttggaacaagccattgagcactacactgctcgccacgatgatgagtcagtgcaagcagggaagctcggtcagtacttcaagcatggactcgcgggtgtggataatcccattcagaagattcataacaaccattcgacgatcaagggatttctcgaacgcgagcgcccggctggcgagagagccttgcccaagatcaagagcggaaaaaaccctgagatgacccagctgagacaattgaaggaactccttgataacgcgctgaacgtggctcactttgctaagttgcttactacaaagacgactctcgataaccaagatggcaatttctatggagaattcggtgttctttacgatgagcttgcgaagatcccgacgctttataacaaggtgagggactacctctcacaaaagccattctcaaccgagaagtacaagctcaactttgggaacccaacactcctcaatgggtgggacctcaacaaagaaaaagacaacttcggggttattcttcagaaagatggctgctactatctggcccttctggataaggcgcacaagaaagtgttcgacaacgccccgaacaccggaaaatctatttaccagaagatgatttataaatatctcgaggtgcgcaaacaattccctaaggtcttcttctcgaaggaagcaatcgccattaattaccacccgtctaaagaactcgtcgagatcaaggataagggccggcagcggtctgatgacgagagacttaagctgtacaggtttatcttggagtgtctgaagattcatccgaagtacgacaagaagttcgagggggctattggcgatattcaactgttcaagaaagacaagaaaggccgggaggttccgatctcggagaaggatctcttcgataagatcaatggcatcttctcctcaaagcccaagctggagatggaggatttcttcatcggagagtttaagcggtacaacccctctcaggacttggtcgatcagtacaatatatacaaaaagatcgattccaatgataatcggaagaaggaaaatttctataataatcaccccaaattcaagaaagatttggtgcggtattattatgaatcaatgtgcaagcacgaggagtgggaggagtcttttgagttctccaagaagctgcaagatatcggctgttacgtggacgtgaatgagcttttcactgagattgaaacccggaggcttaattacaagatttctttttgtaatatcaatgcggactacatcgatgagctggttgagcagggacagttgtatctcttccaaatatataacaaggatttctctcctaaagcccatggaaagccgaaccttcacaccttgtattttaaggcattgttctcagaggacaaccttgctgacccaatctacaaattgaacggcgaagcgcaaatcttctaccggaaagcctcccttgatatgaatgaaacgactatacatagggcaggcgaggtcctcgagaataagaaccctgataaccctaagaaacgccagttcgtctacgacatcatcaaggataaacgctacacgcaggacaagttcatgttgcacgtgccaattacgatgaatttcggggttcaaggtatgacgatcaaagaattcaataagaaagtgaatcagagcatccagcaatacgacgaggtcaacgttataggtatagacaggggtgagaggcacctgctgtaccttaccgtgataaactcaaagggggaaatcctggaacagtgttcactgaacgatattaccactgcctcagcgaacggtacacaaatgaccacgccgtatcacaagattctcgacaagagagaaatcgaacggttgaatgcgagggtggggtggggcgagatagagacaatcaaagaacttaagagcgggtacctctcgcacgttgtgcatcagatttcacagcttatgttgaagtacaatgccattgtcgtgctcgaagacctcaattttggattcaagagaggaaggttcaaggtggagaagcagatctatcaaaactttgagaacgcactcataaagaagctgaaccacctggtcttgaaagataaggctgacgacgagattggctcatacaagaacgcactccagttgacaaataacttcaccgacctgaagtccatcgggaagcagacaggcttccttttctacgtgcccgcttggaacacaagcaagatagaccctgagactggttttgtcgatcttctcaagccaagatatgaaaacatcgctcaatcgcaggcattttttggcaagttcgataagatctgctacaatgctgacaaagactacttcgagtttcacatcgactatgcgaagttcacagataaagcgaagaacagcagacaaatctggacaatctgtagccatggggacaagaggtacgtgtacgacaagactgccaaccaaaacaagggcgccgccaaaggaatcaatgtcaatgatgaacttaaaagcctgtttgcaaggcaccatattaatgagaagcagccgaatctggtgatggacatatgccagaacaacgacaaggaattccacaagtcacttatgtacctgcttaagaccctgttggcactccggtatagcaacgctagctctgatgaagactttatactgtccccggtggctaacgacgagggggtcttttttaacagcgcccttgctgatgatacccaacctcagaatgccgacgcgaatggcgcgtaccacattgcgctgaaagggttgtggctcttgaatgaactgaagaattcagacgacctcaacaaggtcaagctcgccatcgacaaccaaacatggctcaacttcgcgcaaaaccggtaacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 86 - DNA, 7337 bp, Artificial
  synthetic
  Vector_131277 (1)..(7337): Circular Vector
  2X35S_Promoter (492)..(1271)
  Lachnospiraceae bacterium ND2006_cpf1 (1280)..(5062)
  35S_polyA (5070)..(5278)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacacacacagtttaaacatggccccaaagaagaaacggaaggttatgctcaaaaacgttggcattgacagactcgatgttgagaagggtcggaagaatatgtctaagctcgagaaattcactaactgttactctttgtccaaaacgctgcgcttcaaggcaattccggtcggcaagacgcaggagaacatcgacaataagagactgctggttgaggacgaaaagcgggccgaggactataaaggagttaagaagctcctcgatcggtactatctttcgttcattaacgatgttctccactcgattaaactcaagaatcttaataattatataagcctgttccgcaagaagacccgcactgaaaaagagaataaggagttggagaatctggagataaatctgcgcaaagaaatagccaaggccttcaagggcaacgaaggctacaagagcctgtttaaaaaggatataatcgagacaattctgcccgaattcttggacgacaaggacgaaatcgccctcgtcaattcttttaacggcttcacgacggcgttcacggggttcttcgacaacagggagaacatgttcagcgaggaagcaaaatcgacatctatcgctttccggtgcatcaacgagaacctgacccgctacatctctaatatggacattttcgagaaggttgatgcgattttcgacaagcacgaggtgcaggagatcaaagaaaagatactcaactctgactacgatgtcgaagatttttttgagggtgaattcttcaacttcgtcttgacgcaggagggcatagacgtttataacgcgattatcggcggatttgtcacggagtcgggggagaagattaaggggcttaatgagtacatcaacctctacaaccagaagacaaaacagaaactccccaagttcaagccattgtataagcaagttctgtccgatcgggagtcgctctcattctacggcgaaggctacacatccgatgaggaagtcctcgaggttttcagaaacaccctcaacaagaactctgagattttttcctccatcaagaagctggagaagctcttcaagaatttcgacgaatacagcagcgcagggatctttgtgaaaaatgggccggccatttcaacgataagcaaggatatcttcggcgagtggaatgtgataagggataaatggaacgcggagtacgacgatatccacctgaagaagaaagcggtggtcaccgagaaatatgaggatgaccgccgcaagtcgtttaagaaaattggttcgttttcactcgagcagctccaagagtatgctgatgcggatctttctgtcgttgagaaattgaaagagatcatcatacagaaggtggatgagatatacaaggtctacggctcctccgagaagttgttcgatgcggacttcgtcctcgagaagagccttaagaagaacgacgcagtggtggctatcatgaaggatctccttgactcagtcaagagcttcgagaactatattaaggccttcttcggtgaaggtaaggagacaaatagggacgagtcgttttacggcgatttcgtcctggcctacgacatcctgctcaaagttgatcacatctacgacgcgattcggaattacgtgacgcagaaaccgtattccaaagacaagttcaagttgtactttcagaaccctcaatttatgggcggctgggataaagacaaggagactgattatcgggccacaatattgcggtatggctctaagtattacctggctatcatggataagaagtacgctaagtgcctccagaagatcgataaggacgatgtcaatggcaactacgagaaaatcaactataagcttctcccgggacccaacaaaatgctcccaaaagttttctttagcaaaaagtggatggcttactacaatccaagcgaggatatacagaaaatctacaagaatggaactttcaagaagggggacatgttcaatctcaatgattgccacaagctgattgactttttcaaggattcgatcagcaggtatcccaagtggtcgaacgcttatgatttcaatttcagcgagaccgagaaatacaaggacatcgcaggtttctaccgcgaagtggaggagcagggatacaaggtctccttcgagtccgcctctaagaaggaggtggataagcttgtggaagagggtaagctctacatgtttcagatctacaataaggatttcagcgacaagtcccatggtacgcccaacctgcacactatgtactttaaattgctctttgatgagaataaccacgggcaaatccggctctccggcggcgctgagcttttcatgaggcgggcttccttgaaaaaggaggaactggtggtccatccagccaactccccaatcgcgaataagaacccagacaatcctaagaagaccactacattgagctatgacgtttacaaggacaaaaggttttccgaggaccaatacgagttgcatatccctatagcgatcaacaagtgccctaaaaacatttttaagattaatacagaagttcgcgtcttgctcaagcacgacgacaacccgtacgtgatcggcatcgatcgcggagagaggaatcttctgtacatcgtggtcgtggatggaaaagggaatattgttgagcagtacagcctgaatgagatcataaacaattttaatggcatccgcataaagacggattaccactctttgctcgacaagaaggaaaaggaacgctttgaggccaggcagaactggacctccattgaaaacatcaaggaattgaaagcgggttatattagccaggtcgtccacaagatttgcgagcttgttgaaaaatacgatgccgtcatagcccttgaagatctcaactctggattcaagaattctcgcgtgaaggtggagaagcaggtctaccagaagttcgagaagatgctcatcgacaaacttaactacatggtggataagaagtcaaatccttgtgcaaccggcggcgctctgaaggggtatcaaatcactaacaagttcgagtcgttcaaatccatgagcactcaaaatggcttcatattttatattcccgcgtggctcacctctaagatcgacccctcgaccggctttgtgaacctgttgaagaccaagtatacttccattgcagactcgaaaaaatttatatcttcattcgacaggattatgtatgtccctgaagaggatcttttcgagttcgcgctcgactataaaaacttctcgaggacagatgcggattatattaagaagtggaagctgtattcctacggcaacaggattcggattttccggaacccgaagaaaaacaacgtcttcgattgggaagaagtgtgcctgacatccgcttataaagaactgttcaacaagtacggcattaactaccagcaaggagatatcagagccctgctctgtgagcagtccgacaaggccttttattcttccttcatggcactgatgtcgcttatgcttcaaatgcgcaattccatcaccggcaggaccgatgtcgactttttgatctcacctgtcaagaactccgacgggatattctatgacagccggaactatgaggcccaagaaaatgcgatactcccaaaaaatgcggacgccaatggcgcttataatattgcgcgcaaggtcctctgggcaatcgggcaatttaagaaggccgaggacgaaaagcttgataaggtgaagattgcaatttccaacaaagagtggctcgagtatgctcaaacatcagtgaaacattaacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 87 - DNA, 7379 bp, Artificial
  synthetic
  Vector_131278 (1)..(7379): Circular Vector
  2X35S_promoter (492)..(1271)
  Porphyromonas crevioricanis_cpf1 (1280)..(5104)
  35S_polyA (5112)..(5320)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacacacacagtttaaacatggccccaaagaagaaacggaaggttatggattctttgaaggatttcacaaacctctatcctgtcagcaaaaccctgcgcttcgaacttaagccggttggcaagacgcttgaaaacatcgagaaagcgggcatcttgaaggaggacgagcacagagcagaatcgtacagacgcgtcaagaagattatagatacgtatcataaggttttcatcgatagctccctggagaacatggccaagatgggcatcgaaaacgaaatcaaggctatgttgcaatctttctgtgaactctataagaaggaccacaggactgagggcgaagacaaggccctggacaaaatcagggccgttcttcgcggtctgattgtcggcgcattcacaggtgtttgtgggaggcgggaaaataccgttcagaacgagaagtacgagtctctctttaaggaaaagttgataaaagagatcctccccgacttcgtgctcagcacagaggcggagtctctccccttctcagtggaggaagctacgaggtcgcttaaggagttcgactcctttacttcgtatttcgctggattttatgagaatagaaaaaacatttatagcactaagccgcagtcaaccgccattgcgtacagacttatacacgaaaatttgcccaaattcatcgacaatattctggtgttccagaagattaaggagcctatcgctaaggaactcgaacacatcagagctgacttctcggcaggcgggtacataaaaaaggacgagagacttgaggacatcttctccctcaactactacatccacgttctctcacaagcgggcatcgagaagtataatgcactcattggtaaaatagtgacagagggtgacggagagatgaaaggtctcaacgaacatataaacctgtataatcagcagaggggaagggaagatagacttcccctttttaggcctttgtataaacaaattttgtccgaccgggagcaattgtcatacctgccggagtccttcgagaaggatgaggaactcctgagggctttgaaggagttttacgaccacattgccgaagatattttggggagaactcaacagctcatgacatcaatctctgagtacgatcttagcagaatttatgtgaggaacgactcacagctcactgatatctccaagaagatgctcggagattggaacgctatttatatggctcgggagcgggcttatgatcatgagcaggcccccaaaaggattacggctaagtatgagagggatagaattaaggcgcttaagggcgaggaatccatttcgctggccaatctgaactcatgtatagcctttcttgataacgtccgcgattgcagagttgatacatacttgtcaacacttggtcagaaggagggcccccacggtctctctaaccttgtggagaatgtcttcgcatcctaccatgaggccgaacaattgctttctttcccctacccagaggagaacaaccttattcaagataaagataatgtcgtcctgatcaaaaaccttctggacaacatctccgaccttcagagatttcttaaacctctgtggggaatgggtgatgagccagataaggatgagcggttctatggagagtacaactacattcggggtgcacttgaccaggtgatacctctgtacaacaaagtccggaactatctcacaagaaagccctattcgactcggaaggtgaagctgaatttcggcaatagccagctgttgtccggatgggatcgcaataaggagaaggataattcctgcgttatactccggaaaggacaaaacttctacttggcaatcatgaacaatcggcataagcgcagcttcgagaataagatgcttccagaatataaggagggtgaaccttattttgagaagatggattataagttcctgcccgatcctaacaagatgcttccaaaggtcttcctgtcgaagaaaggcatagaaatctataagcccagccccaagctgcttgagcagtatggccacggcacccataagaagggggatacgttttccatggatgacctgcatgaacttatagacttctttaagcattctattgaggctcatgaggattggaagcaatttgggttcaagttttctgacactgcaacatacgagaatgtctcttcattctacagggaggttgaggaccaaggatataaactgtctttccggaaggtgtccgagtcatacgtttacagcctgatcgatcagggcaagctctacctgttccaaatatacaataaggatttctctccttgttccaaaggtactcccaacctccacaccttgtactggcgcatgttgtttgatgaaaggaatctcgccgacgtcatttacaaactcgatggtaaggccgagatcttctttagagaaaaatcactgaagaacgaccatcctacgcatccagcggggaagcccatcaagaaaaaatccaggcagaagaagggcgaagagagcctctttgaatacgaccttgtgaaggacaggcgctatactatggataagtttcaatttcatgtgcccatcactatgaatttcaagtgctcagcagggtccaaagtcaacgatatggttaacgcacatatccgcgaagctaaggacatgcacgtgattggtattgatagaggagagcgcaatcttctgtacatatgcgtgatcgatagcagggggactatccttgaccaaatttctttgaacacaattaatgacatagattaccacgaccttcttgaaagccgcgataaggacaggcaacaggagcacaggaactggcagaccattgagggcatcaaagagttgaaacagggatatcttagccaagcagtgcacagaatcgccgaactcatggtggcgtacaaagcagtggtggccctcgaggaccttaacatgggcttcaagcgggggcggcagaaggtcgaatcttccgtctaccagcagttcgaaaagcaactgattgataagcttaattacctggtggacaagaagaagaggccggaggacataggcggtcttttgcgggcataccaattcaccgcacctttcaagagcttcaaagaaatggggaaacaaaacgggttcttgttctatattcctgcgtggaacactagcaatatcgaccccactactggcttcgttaaccttttccatgtgcaatacgaaaacgtcgataaggcaaagtcctttttccagaagttcgactctattagctacaaccctaagaaagactggttcgagtttgccttcgactacaagaatttcacaaagaaggccgagggctcgagaagcatgtggatattgtgcactcacggttcgcgcatcaaaaactttcgcaactcacagaaaaacggccaatgggattctgaggaatttgctctcacggaggcatttaagtcgctgttcgtgaggtacgagatcgattacacggccgatttgaagactgcaatcgttgacgagaagcaaaaggacttctttgttgatcttctcaaattgttcaagttgacagtgcagatgaggaactcttggaaagagaaagacctcgattaccttatttcgcctgtcgcgggcgccgatggaagatttttcgatacgagggaaggtaataagtctctgccaaaggatgcagatgcgaatggtgcttacaacatcgccctgaagggtctttgggctctccggcagattcggcagacctccgagggcggaaaacttaagttggcgatttccaacaaggagtggttgcaatttgtgcaagagaggtcatacgagaaggactaacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 88 - DNA, 7553 bp, Artificial
  synthetic
  Vector_131279 (1)..(7553): Circular Vector
  2X35S_promoter (492)..(1271)
  Prevotella disiens_cpf1 (1280)..(5278)
  35S_polyA (5286)..(5494)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgtaactataacggtcctaaggtagcgagcgatcgcgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctgtttaaacatggccccaaagaagaaacggaaggttatggagaattaccaggagtttacgaacctcttccagctcaacaagacactcaggtttgaattgaagccaataggtaaaacttgtgaactcctggaggagggaaagatttttgccagcggatcgttccttgagaaggacaaggtcagagccgataacgtctcctacgtcaagaaggaaatagacaagaagcacaaaatcttcattgaggagacacttagctcctttagcatatctaacgacttgcttaaacaatatttcgactgctacaatgagctgaaggccttcaagaaagattgtaagtcagacgaggaggaggtcaagaagaccgcgctgaggaacaaatgtacgagcatccagcgcgcgatgcgggaggctatctcacaggctttccttaaatccccgcagaaaaaactcttggctattaaaaacctcattgagaatgttttcaaggctgatgaaaacgtccaacatttttccgagttcacgtcgtatttctctggattcgagacaaatagagagaatttctattctgacgaggagaagagcacctctattgcatataggctcgtgcatgataacctcccaatatttattaaaaatatttatattttcgaaaagctgaaagagcagttcgacgctaagactctgtcagagatcttcgagaattataagttgtacgtcgccggctcctctttggacgaagtgttctctcttgagtatttcaacaacactctcacacagaagggcatcgataattataacgctgtgataggaaagatcgttaaggaggataagcaggagattcagggtctgaacgagcacattaatctgtacaatcagaagcacaaggacaggcggttgccattcttcatctcacttaagaagcaaatcttgtcagaccgggaagccctgtcctggttgcctgacatgttcaagaacgacagcgaggtgataaaggctcttaaaggcttctatattgaggacgggttcgaaaataatgtgttgaccccccttgccacccttctgtcctccttggataagtacaaccttaatggaatcttcatccggaataatgaggcattgtcgtccctttctcagaacgtctacaggaacttttctattgacgaggcgattgatgctaatgccgagctgcagacattcaacaactacgaacttatcgccaacgctcttagagcgaagatcaagaaagaaacgaagcaaggccgcaagtcattcgagaaatatgaggaatacattgacaaaaaggttaaggcaatagactctctgtctattcaggagatcaacgagcttgtggagaattatgtttccgaatttaactctaattcgggtaacatgccaagaaaagtggaagattatttcagccttatgcggaagggggatttcggctcgaacgatcttatcgagaatattaagactaaactgtcagctgctgaaaagctcttgggcaccaagtatcaggaaacggcgaaggatatcttcaaaaaggatgaaaactccaaactgattaaggagctgctcgatgctaccaagcagttccaacactttataaaacctttgctgggcactggggaggaggcggacagggatctcgtcttttacggcgacttccttccgctttacgagaagttcgaggaactgacgcttctctataataaggttcggaacagacttacccagaagccctactcgaaggacaagatcaggctgtgctttaacaaaccgaagctcatgaccggatgggtggactcaaaaacggagaagtcggataacgggacgcaatacggcggctatctttttagaaaaaagaatgaaatcggggagtatgattacttcctcggcatatcttccaaggcacagctctttagaaaaaacgaagcggtcatcggcgactatgaacgcctcgattattaccaaccaaaagccaacaccatctacgggtctgcatacgagggcgagaactcatacaaagaggataagaagaggctgaacaaggtcatcatcgcatacatagaacagatcaagcaaacaaacataaagaaatcaatcatcgagtcaattagcaagtacccaaatatctcggacgatgacaaagttacgccctcatccctgctcgaaaaaatcaaaaaggtttcaattgactcatacaatggcattctctctttcaaatcattccaatctgtgaataaggaggtgattgacaatttgttgaagacaatcagccctcttaagaacaaagcagagtttctggatctgatcaacaaggactatcagatttttacagaggtccaggcggtgatcgacgaaatttgcaaacagaaaacttttatctatttccccatctctaacgtcgagcttgagaaggaaatgggcgacaaagataagcccctctgcttgtttcaaatctctaacaaggatctgtcttttgcaaagacattcagcgcaaacctccggaagaagcgcggggctgagaatttgcatacgatgctttttaaagctttgatggaaggcaaccaggataatctcgatctgggcagcggtgccattttttatagggccaagtcactggatggcaataagcccacccaccccgcgaacgaggccattaagtgccgcaacgtcgcgaataaggacaaggtttccctctttacttacgatatttataagaacaggagatatatggagaacaagttcctgtttcatctcagcatagttcaaaactacaaggcggcaaacgactctgcccagctgaattcatcggctacagaatacatcaggaaggccgatgacctgcacatcatcggtatcgaccgcggcgagcggaatctgctctactattccgttatagacatgaaaggtaacatcgtggagcaggacagcctgaatattattcgcaataacgacctcgagaccgattatcatgacctgctcgacaagcgggagaaagagcggaaggctaataggcaaaactgggaggctgttgagggcattaaggacctgaagaaaggttatttgtcacaagctgtgcaccagatagcccaactgatgcttaaatacaatgctattatcgcgctggaagatcttggccagatgttcgtcactagaggtcagaagatcgagaaggctgtctatcagcagttcgagaagtcactcgtggataaactcagctacctcgtggataaaaagaggccttacaatgaacttggtggtattcttaaggcataccagctcgctagctccataacaaagaataattctgataagcagaacggcttcctcttttatgtgcctgcttggaatacatccaagatcgacccagtgacgggatttactgacctcctccggccgaaggccatgacaatcaaggaggcccaggatttttttggcgcctttgacaatatcagctacaacgacaaaggctacttcgaatttgagaccaattacgataagttcaagatcaggatgaagtcggcccagactaggtggacgatctgtactttcggtaatcgcatcaagcggaagaaagacaaaaattactggaactatgaagaagtcgaactgacggaagaattcaagaagttgtttaaagactccaacatcgactacgagaactgcaacctgaaggaagagatccagaacaaggataatcgcaagtttttcgacgatcttattaaactccttcagcttacgctgcagatgcgcaattcagacgacaaggggaacgactacattataagcccagtcgccaatgctgagggacaattcttcgactccaggaacggcgacaagaagctcccgcttgatgccgacgctaacggcgcctacaatatagcaaggaaaggtctgtggaacataagacaaattaagcagacgaagaacgataaaaaacttaacttgtctatttcatcgacggagtggctggatttcgttagagagaagccttacctgaagtgacggaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattagcggccgcattaccctgttatccctaaagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 89 - DNA, 5302 bp, Artificial
  synthetic
  Rice_CAO1_Repair_Donor (1)..(5302): From Vector 131632
  Upstream_homologous_arm (1)..(1000)
  CaMV_35S_terminator (1001)..(1244)
  hygromycin_resistance_gene (1245)..(2277)
  ZmUbi_promoter (2310)..(4302)
  Downstream_homologous_arm (4303)..(5302)
tccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggaggtggacggaggagggatcaacggctgagatgcgttcctgcgtgccacgtggtgcgccgcgagcagataagggttcagggcgtcgcgacggggtcgagagataaggggcgcgcggcgagtggcgcgccacgtcgcgtggcccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaaagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgccttcaggtgttgctccaggcaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcct

SEQ ID NO: 90 - DNA, 5302 bp, Artificial
  synthetic
  Rice_CAO1_Repair_Donor_Cassette (1)..(5302): From Vector 131633
  Upstream_homologous_arm (1)..(1000)
  CaMV_35S_terminator (1001)..(1244)
  hygromycin_resistance_gene (1245)..(2277)
  ZmUbi_promoter (2310)..(4302)
  Downstream_homologous_arm (4303)..(5302)
aggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctagctccagtgacctaaaagacagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggaactgtcctgtgcatttcaagatttttactggactgaaaagtaatggaattgttcttgatcatcaacagatagtgatggagctaccagtggagcatggacttcttctggacaatctattagatcttgctcatgctccttttactcatacatccacctttgccaagggttggagtgttccaaggtatttacatacatatattttcacagccatgtggaattcttttttttttttttagaaaatggatagccatgtggaaatgtcttcagaaatcatcatgctgatgctatgttcatttcccagcttggtgaagttcttgacaccttcatctgggcttcaaggatactgggatccatacccgatcgacatggaatttcgaccaccat

SEQ ID NO: 91 - DNA, 43 bp, Artificial
  synthetic
  Fncpf1_gRNA2-rice_CAO1 (1)..(43)
  Fncpf1_scaffold (1)..(19)
aatttctactgttgtagattccagtgacctaaaagacgataca

SEQ ID NO: 92 - DNA, 43 bp, Artificial
  synthetic
  Ascpf1_gRNA1-rice_CAO1 (1)..(43)
  Ascpf1_scaffold (1)..(19)
aatttctactcttgtagattggagcaacacctgaaggaaggct

SEQ ID NO: 93 - DNA, 43 bp, Artificial
  synthetic
  Ascpf1_gRNA2-rice_CAO1 (1)..(43)
  Ascpf1_scaffold (1)..(19)
aatttctactcttgtagattccagtgacctaaaagacgataca

SEQ ID NO: 94 - DNA, 45 bp, Artificial
  synthetic
  Mbcpf1_gRNA1-rice_CAO1 (1)..(45)
  Mbcpf1_scaffold (1)..(21)
aaatttctactgtttgtagattggagcaacacctgaaggaaggct

SEQ ID NO: 95 - DNA, 45 bp, Artificial
  synthetic
  Mbcpf1_gRNA2-rice_CAO1 (1)..(45)
  Mbcpf1_scaffold (1)..(21)
aaatttctactgtttgtagattccagtgacctaaaagacgataca

SEQ ID NO: 96 - DNA, 26 bp, Artificial
  synthetic
  OsCAO1_upstream_primer (1)..(26): produces an amplicon with SEQ ID NO:97 following insertion event at OsCAO1 genomic locus
ggacagcagcaagtgccgaaaaattc

SEQ ID NO: 97 - DNA, 33 bp, Artificial
  synthetic
  35S_terminator_primer (1)..(33): Produces an amplicon with SEQ ID NO:96 following insertion at the OsCAO1 locus
ccaaaatccagtactaaaatccagatcccccga

SEQ ID NO: 98 - DNA, 22 bp, Artificial
  synthetic
  OsCAO1_fwd_primer (1)..(22): Amplifies a PCR product from the OsCAO1 locus with SEQ ID NO:99
ccccgcaagtatttgtattcac

SEQ ID NO: 99 - DNA, 23 bp, Artificial
  synthetic
  OsCAO1_rev_primer (1)..(23): Amplifies a PCR product from the OsCAO1 locus with SEQ ID NO:98
aagaatcgccaaacaacaacaac

SEQ ID NO: 100 - DNA, 20 bp, Artificial
  synthetic
  Fncpf1_fwd_primer (1)..(20): Amplifies an 853-bp amplicon with SEQ ID NO:101 from vector 131272
ggcaagtggactatcgcatc

SEQ ID NO: 101 - DNA, 20 bp, Artificial
  synthetic
  131272_rev_primer (1)..(20): Amplifies an 853-bp amplicon with SEQ ID NO:100 from vector 131272
cagctggcacgacaggtttc

SEQ ID NO: 102 - DNA, 21 bp, Artificial
  synthetic
  OsCAO1_upstream_primer (1)..(21): Amplifies 1.1kb fragment with SEQ ID NO:103 following insertion of CaMV terminator in OsCAO1 locus
gctccagaaaggtgagttctt

SEQ ID NO: 103 - DNA, 33 bp, Artificial; identical to SEQ ID NO: 97
  synthetic
  CaMV_terminator_primer (1)..(33): amplifies 1.1kb region with SEQ ID NO:102 when CaMV terminator is inserted at OsCAO1 locus

SEQ ID NO: 104 - DNA, 19 bp, Artificial
  synthetic
  OsCAO1_primer (1)..(19)
gctgcactgcagaagcttg

SEQ ID NO: 105 - DNA, 27 bp, Artificial
  synthetic
  OsCAO1_primer (1)..(27)
gccaatggttgacaacaccatgcatgg

SEQ ID NO: 106 - protein, 1298 aa, Thiomicrospira sp. XS5
  Cpf1 (1)..(1298)
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 107 - protein, 1251 aa, Bacteroidetes bacterium GWF2_33_38
  Cpf1 (1)..(1251)
MNHMKQFTNQFSLSKTLRFELIPQGKTKEFIEINGLIEKDNERAVSYKKVKKIIDEYHKYFIEMVLCDFKLHGLETYETIFNKKEKDDTDKKEFDNIRNSLRKQIADAFAKNPNDEIKERFKNLFAKELIKQDLLNFVDDEQKELVNEFKDFTTYFTGFHQNRRNMYVADEKATAIAYRLVNENLPKFIDNLKIYEKIKKDAPELISDLNKTLVEMEEIVQGKTLDEIFSLSFFNQTLTQTGIELYNIVIGGRTADEGKTKIKGLNEYINTDYNQKQTDKKKKQAKFKQLYKQILSDRHSVSFVAETFETDAQLLENIEQFYSSVLCNYEDDGHTTNIFEAIKNLIIGLKTFDLSKIYLRNDTSLTDISQKLFGDWSIISSALNDYYEKQNPISSKEKQEKYDERKAKWLKQDFNIETIQTALNECDSEIIKEKNNKNIVSEYFAKLGLDKDNKIDLLQKIHHNYVVIKDLLNEPYPENIKLGNQKEQVSQIKDFLDSILNLIHFLKPLSLKDKDKEKDELFYSLFTALFEHLSQTISIYNKVRNYLTQKAYSTEKIKLNFENSTLLNGWDVNKEPVNTSVIFRKNGLFYLGIMSKSNNRIFERNVPVCKNEETAFEKMNYKLLPGANKMLPKVFLSAKGIESFQPSAEIQSKYQKETHKKGDAFVRKDMENLIDFFKQSIAKHTDWKHFNHQFSKTETYNDLSEFYKEVEKQGYKLTFTKLDETYINQLVDEGKLYLFQIYNKDFSPFSKGKPNMHTLYWKMLFDEQNLQNVVYKLNGEAEVFFRQSSIKQTDRIIHKANQAIDNKNPLNNKKQSSFNYDLIKDKRFTLDKFQFHVPITLNFKAEGNEYLNTKVNEYLKSNSDVKIIGLDRGERHLIYLTLINQKGELLKQQSLNVIATSQEHETDYKNLLVNKENERANARQDWKTIETIKELKEGYLSQVVHQIATMMVDENAIVVMEDLNAGFMRGRQKVERQVYQKLEKMLIEKLNYLVFKNNDVNETAGVLNALQLTNKFESFEKMGKQSGFLFYVPAWNTSKIDPATGFVDFLKPKYESVEKAKLFFEKFESIKFNADKNYFEFEFDYKKFTEKAEGSQTKWTVCTHSDVRYRYNPQTKASDEVNVTNELKLIFDKFKIEYKNGKNLKTELLLQDDKQLFSKLLHYLALTLMLRQSKSGTDIDFILSPVAKNGVFYDSRNAMPNLPKDADANGAFHIALKGLWCVQQIKKADDLKKIKLAISNKEWLSFVQNLK

SEQ ID NO: 108 - protein, 1289 aa, Nitrospinae bacterium
  Cpf1 (1)..(1289)
MENKELFNSFTKKCQLSKTLRFELVPQGETEKFIKKKGLLKQDKDRADDYRKAKKLIDEYHKDFIEHALSGKQLKKLQAYYDEFTALLGKPAKERDTRVLSNISEALRKEIAGWLKDNPIKDEKKLIKEIVPNFLKSKDRNDDAALVLKFKGFTTYFGGFNENRRNMYSAEEKSTAIAYRIVHENLPKFISNMKTFQRLTENHKIDFLEVETQMNDELDGNKLKDVFSIDYFNQCLTQSGIDRYNTILGGKTDSRGAQIQGVNIKINLFGQKNNLKSKDAPVLARLYKQILSDRTSASFLPEKFETAKELIASIREFYEKAINGFIKNNERKNVIDEIESLFNKKLNPTDCDLSQIYIRNIFISAVSQQIFGSYSVITSALNAFIDKTYKTKKEKEKQQKKSYFGIAEIEAALKAYLQETEIENKEKREEVLKHANPVLQYLNSLTTNIEINNKKEKANVIVRFRQQHEAVQSVLNKEYGNNSELIQDKNAVAAIKDYLDSCQHILHFVKPLFVVPPKKENAELPDKDAFYSEFDELFEQLKSVTPLYNMVRNFLTQKPYSTEKIKLNFENVSLLSGWDVNKETDNTSVIFRKDSLYYLGIMDKKHNKVFHDIPASSDNDFYEKMNYKLLPGANKMLPKVIFSDRWIEYFNPSKELIEKYKKGTHKKGEIFSLSDCHALIDFFKTSIAKHEDWKQFNFQFSPTKTYQDINEFYREVEHQGYKISFQNVSAKYIHQLVSEGKLFLFKIYNKDFSPYSKGKPNLHTLYWKAVFDKENLKDVVVKLNGEAEVFYRPQSIPKKSKIVHKKNKPIVNKNPNNPKKQSLFKEYDIVKDKRYTEDKYHFHVPITLNFKEAKVPSENDRKKAFAYTFNKGANETLKENFPNIIGIDRGERHLAYYSLINSKGEILEQGSFNVIKNEFNGTKHETDYYASLVEKEKARDAARKSWDTIGKIKELKEGYLSQVVHKIARMMIEHNAIIVLEDLTMKFKDIRKKVERQVYQKLEKMLIDKLNYLVFKDREAYEPGGVLNAYQLAAPFTSFKDMGKQTGFIFYVPAANTSKIDYATGFMNFIYPKIEDAVEFFQKFEYIRFNPDKNYFEFAARYNNFVKDDEAKLPDEYNEPWIICTHGEQRFQYQPSYKSFKEVNVTQELQDLFSKHAIMPYAHGNDLSPQIKDKGNTSFYKGLIALLRLVLQMRYTDGKGRDFILSPVANDEGVFFNSEKAKETEPNDADANGAYHIALKGLLLLKRIKGEFKKEEKTGKKKTQKENWIDLSISNKEWYEFAQKKEYRK

SEQ ID NO: 109 - protein, 1271 aa, Planctomycetes bacterium GWC2_39_26
  Cpf1 (1)..(1271)
MNSSNDAKKDFSSFTNKYQLSKTLRFELIPQGKTREHIETKGLLQRDEHRAESYKKVKKIIDEYHKVFIEKAMKDFRLEGLENFKLLYLKKEKEDKDKKELQEVMKGLRKQIAACFSNNKDESVAAIYKNLFAKELIKKDLKDFVKEEDKELIEEFEDFTTYFTGFHENRKNIYTHEEKSTAIAYRLIHENLPSFLDNLGVYQSIKEDHPDLDFSPMEKELYEVLNGMRVKGIEEVFTLDFFNNMLTQKGIDAYNAILGGKSEKGQRKIKGVNEYIHEHRQLKGLTLRQLPNLKPLYKQILSDRESISFLPEYFEKDQELLDSIKAFYQNGLCSWEKDGKTQDVLQEIENLLLPLNEFDLEKIFIKNDISLTGISQKIFGDWSFIGDALGSYYEHKNPLPKKLTKTYEEKKEKWVTETTHFSIADIQRALDLYKTKNEEAKEKITASILCSFFGSMGEVQVAGEPKAPNLLQRIEESYGPVTDLLNTPYPENRKLAQDKAEVSKIKNFLDTVMDLLHFIKPLHPRENIQEKDVKFYNAYSTLFDQLNLITDLYNKTRNYLTKKPYSTEKIKLNFENSTLLDGWDANKETDNTSVLLRKNGFFYLAIMDKKHNRIFNQIPKLNNGEASYEKMNYKLLPLINQQLPRVFFAKSRIEYFNPSQEILKNYENDTHKKGETFNINDCHALIDFFKASLERHEDWKNFNFKFSPTTSYEDLSGFYREVEQQGYKVTFQNVPENYINRMVEEGKLYLFQIYNKDFSPFSKGKPNLHTLYWKMLFAEENLKNVVYKLNGQAEVFFRKKSLNYDEKILKTGHHAEKLKDRFNYPIISNRRFAFDKFQFHVPITLNFKATGNGNINQDVLTYLKNNPNVNIIGIDRGERHLLYVTLIDQQRNIKQQFSLNEIVNRYNGKEYATNYHAKLDAKEKDRDVARKSWGVIENIRELKEGYLSQVVHQIAGMMVEHNAVVVMEDLNFGFKRGRQKVEKQVYQKFEKMLIDKLNYMAFKNKEAAETGGVLNALQLSNKFDSFQKLGKQSGFIFYVPAWHTSKIDPATGFVDFFKPKYENIEKAKEFFGNFKSICFNRGKNWFEFDFDYNKFTPKAEDTRTQWTVCTTPEVRYVWNRNKETANGRGGYDEYLITEKMKSLFDGEDIRIRYQNGSDIKREIVGQSSGQFFKELTRLLGVTLSLRYNNGKKGDAEKDFILSPVANNKGEFFNSLKADASQPQNADANGAYHIALKGLWVLHQINEANDLKKVKLAISNKEWLQFVQRYES

SEQ ID NO: 110 - protein, 1242 aa, Bacteroidales bacterium KA00251
  Cpf1 (1)..(1242)
MKKFTNLYPVQKTLRFELIPQGNTSKHLCKIIQEDEQIAEDSQEVKKLLDRYHKEFIAIALSSFPTSPLAKEIIPKLKEFAQIRATGDAKQISTIQDELRELVVKGFKGEGEQERRYKILIGAKGNPNADELFNTELINFLKDPAEQALVKKFQKHTGYFLGFNENRKNMYSAKAQSTAIAYRLIHENLPRFLDNITTYEKVKTYLKEEIPQLEKELVRAGASLVSHVDSVFTIDFFLEVFTQSGIDQYNALIGKIVNQEQGEVKGLNERINLYNQQHKQEAKLPLFKPLYKQILSDREQLSWLAEAYNSDKDLLDSIQKYYQLLIDNQIFERIPRLMHTLEKAPLDKIWITYDTQLTSISNTLYGSWRVIGEALGRNAKSEKERKSSQKKALNYSLESINQAIAKMPSDEELPPIQKYFIALGSNPSKKDASSGTLVDKVRSSYKACQDILTNPDHTGKKLIQDKKQVDLLKQLLDDLLILQRFIKPLLYSNNENETHKDEVFYTELTDIMDLLNPIVGLYNKVRNYLTQKPYSTEKFKINFKSSSLLAGWDRNKEKDNLGVILKREDKYYLAIMDKAHNATFKNKSLPTQGECYEKMEYKLLPGANKMLPKVYITSKKGIESFHPSEELQKKYKLGTHKKGASFNLSDMRALIDYFKESLEKHEEHSQFGFHFSDTSTYEDISGFYREVEQQAYKITFRKVSVEYIDQLVNEGKLYLFQIYNKDFSPYSKGTPNLHTLYWKMLFDPANLQDIVYKLNGEAEVFFRKKSLQYDRPTHPKGQPINKKSLLNEGETSLFDYDLIKDRRFTVDKFQFHVPITMNFKATQGTKVNQMVQEEVKKSKGFHLIGIDRGERNLLYIVVINERGEIIEQCSLNKIVNTYQEKEHTVDYKALLEKRSQSRLEERKSWQTIENIKELKGGYLSQVVHKIAQLMIKYNAIAVLEDLNFGFIRTRKKFEFSVYQEFEKKLIDKLGYVVDKKAPIQQEGGLLQAYQLTAPFKSFREMGKQNGFLFYVPAWNTSAIDPRTGFVNLLDTRYESIAKTKELIKKLKDIRYNSQKDWFEIDLDYNAFGNRAKGSRSKWRLCSYGERIEHTRKQDSNGQEESDSMVVLTEAFKDVFTKYQIDYRENLKEQLLLQSDKAFFVDFLSLLRLTLQLRNSLSNSLIDYILSPVADENGEFFDSRKALSNEPQDADANGAYHIALKGLWVLDKIRKTEKVTPAKLALSNQEWLSFAQEKPFFNE

SEQ ID NO: 111 - protein, 1263 aa, Eubacterium rectale
  Cpf1 (1)..(1263)
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKEMSLDEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSRFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKENDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFANIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 112 - protein, 1259 aa, Clostridium sp.
  Cpf1 (1)..(1259)
MNYKTGLEDFIGKESLSKTLRNALIPTESTKIHMEEMGVIRDDELRAEKQQELKEIMDDYYRAFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDIAVNERTLAYIAKKEDIHIIGIDRGERNLLYISVIDVHGNIREQRSFNIVNGYDYQQKLKDREKSRDAARKNWEEIEKIKELKEGYLSMVIHYIARLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGEFDEIRYDRDKNMFEFSFDYNNYIKKGTMLASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 113 - protein, 1305 aa, Lachnospira pectinoschiza
  Cpf1 (1)..(1305)
MNKAADNYTGGNYDEFIALSKVQKTLRNELKPTPFTAEHIKQRGIISEDEYRAQQSLELKKIADEYYRNYITHKLNDINNLDFYNLFDAIEEKYKKNDKDNRDKLDLVEKSKRGEIAKMLSADDNFKSMFEAKLITKLLPDYVERNYTGEDKEKALETLALFKGFTTYFKGYFKTRKNMFSGEGGASSICHRIVNVNASIFYDNLKTFMRIQEKAGDEIALIEEELTEKLDGWRLEHIFSRDYYNEVLAQKGIDYYNQICGDINKHMNLYCQQNKFKANIFKMMKLQKQIMGISEKVFEIPPMYQNDEEVYASFNEFISRLEEVKLTDRLRNILQNINIYNTAKIYINARYYTNVSTYVYGGWGVIESAIERYLCNTIAGKGQSKVKKIENAKKDNKFMSVKELDSIVAEYEPDYFNAPYIDDDDNAVKVFGGQGVLGYFNKMSELLADVSLYTIDYNSDDSLIENKESALRIKKQLDDIMSLYHWLQTFIIDEVVEKDNAFYAELEDICCELENVVTLYDRIRNYVTRKPYSTQKFKLNFASPTLASGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFKETNQYNDIGQFYKDVEKQGYSISWAYISEEDINKLDEEGKIYLFEIYNKDLSAHSTGRDNLHTMYLKNIFSEDNLKNICIELNGEAELFYRKSSMKSNITHKKDTILVNKTYINETGVRVSLSDEDYMKVYNYYNNNYVIDTENDKNLIDIIEKIGHRKSKIDIVKDKRYTEDKYFLYLPITINYGIEDENVNSKIIEYIAKQDNMNVIGIDRGERNLIYISVIDNKGNIIEQKSFNLVNNYDYKNKLKNMEKTRDNARKNWQEIGKIKDVKSGYLSGVISKIARMVIDYNAIIVMEDLNKGFKRGRFKVERQVYQKFENMLISKLNYLVFKERKADENGGILRGYQLTYIPKSIKNVGKQCGCIFYVPAAYTSKIDPATGFINIFDFKKYSGSGINAKVKDKKEFLMSMNSIRYINEGSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKFKENELYINVTEWLDYIQNRRFE

SEQ ID NO: 114 - protein, 1272 aa, Clostridium sp.
  Cpf1 (1)..(1272)
MEDKQFLERYKEFIGLNSLSKTLRNSLIPVGSTLKHIQEYGILEEDSLRAQKREELKGIMDDYYRNYIEMHLRDVHDIDWNELFEALTEVKKNQTDDAKKCLEKIQEKKRKEIYQYLSDDAVFSEMFKEKMISGILPDFIRCNEEYSEEEKEEKLKTVALFHRFTSSFNDFFLNRKNVFTKEAIATAIGYRVVHENAEIFLENMVAFQNIQKSAESQISIIERKNEHYFMEWKLSHIFTADYYMMLMTQKAIEHYNEMCGVVNQHMKEYCQKEKKNWNLYRMKRLHKQILSNASTSFKIPEKYENDAEVYESVNSFLQNVMEKTVMERIAVLKNNTDNFDLSKIYITAPYYEKISNYLCGSWNTIADCLTHYYEQQIAGKGARKDQKVKAAVKADKWKSLSEIEQLLKEYARAEEVKRKPEEYIAEIENIVSLKEVHLLEYHPEVNLIENEKYATEIKDVLDNYMELFHWMKWFYIEEAVEKEVNFYGELDDLYEEIRDIVPLYNKVRNYVTQKPYSDTKIKLNFGTPTLANGWSKSKEYDYNAILLQKDGKYYMGIFNPVQKPEKEIIEGHSHPLEGNEYKKMVYYYLPSANKMLPKVLLSKKGMEIYQPSEYIINGYKERRHIKSEEKFDLQFCHDLIDYFKSGIERNPDWKVFGFHFSDTDTYQDISGFYREVEDQGYKIDWTYIKEADIDRLNEEGKLYLFQIYNKDFSEKSTGRENLHTMYLKNLFSEENIREQVLKLNGEAEIFFRKSSVKKPIIHKKGTMLVNRTYMEEMHGESVKKNIPEKEYQEIYNYMNHRWKGELSAEAKEYLKKAVCHETKKDIVKDYRYSVDKFFIHLPITINYRASGKEALNSVAQRYIAHQNDMHVIGIDRGERNLIYVSVINMQGEIIEQKSFNVVNKYNYKEKLKEREQNRDEARKNWKEIGQIKDLKEGYLSGVIHEIAKMMIKYHAIVAMEDLNYGFKRGRFKVERQVYQKFENMLIQKLNYLVFKDRSADEDGGVLRGYQLAYIPDSVKKLGRQCGMIFYVPAAFTSKIDPATGFVDIFNHKAYTTDQAKREFILSFDEICYDVERQLFRFTFDYANFATHNVTLARNNWTIYTNGTRTQKEFVNRRVRDKKEVFDPTEKMLKLLELEGVEYQSGANLLPKLEKISDPHLFHELQRIVRFTVQLRNSKNEENDVDYDHVISPVLNEEGKFFDSSKYENKEEKKESLLPVDADANGAYCIALKGLYIMQAIQKNWSEEKALSPDVLRLNNNDWFDYIQNKRYR

SEQ ID NO: 115 - protein, 1307 aa, Succiniclasticum ruminis
  Cpf1 (1)..(1307)
MGNFGEFTHKYQVSKTLRFELIPQGKTLENVAKYGIVDDDKRRSENYKKLKPVIDRIYKYFIDESLKNVSIDWQPLYEAIIAYRKEQTTANVVRLKEEQEACRKAIAAWFEGKVPDKGSKDLKEFNKTQSKLFKELFGKELFTESVTQLLPGLSLTEEEKELLASFNKFTSYFKGFYVNRKNVFSADDISTSIPHRLVQENFPKFMDNCEAYRRIVEEYPELKAKLEGTAQATGIFIGFKLDNIFKVSFYNHLLQQSQIDLYNQFLCGIAGEEGTMRVQGLNVTLNLAMKQDKVLGQKLKSMPHRFIPLYKQILSDRTTLSFIPEAFQNDEEVLLTVEEYRKSLEAERTTGAVSDIFNSLQAADLRHVYVNPAKLTAFSQMLFEDWSLCRESLRNWKLRSYGKAATKKVREEIESWLKESAISLDELQAALADGTLSVIINQKVQSVITTLEQELAKPLPKKLKTAEEKESLKSLLDSVQEACHSLEMFAVGENMDTDPCFYVPLREAMEAIQPIIPLYNKVRNFATQKPYSIEKFKLNFSNPILASGWDENRERQTCAILFRKGEKYYLGIYNAKVKPDFSIIKAVKGGNCFEKVVYRQFPDFSKMMPKCTTQLKEVQQHFASSSEDYVLYNKKFIKPLTITKEIYDLNNVLFDGKKKFQIDYLRKTKDEDGYYHALHTWINFAKEFVASYESTSIYDTSTVLSTEQYVKLNDFYGDLDNLFYRIKFESVSEETISEFVDEGKLFLFQIYNKDFAEGATGAPNLHTIYWKAVFDPENMKNVVVKLNGQAELFYRPKSAMDIVRHKVGEKLVNRRLKDGTSLTEELHEELYLYANGKLKKKLSEAAAAVLPQAVIYDVHHEIVKDRRFTEDKFFFHVPLTLNYKCDKNAVQFNASVQEYLKENPDTYIIGIDRGERNLIYAVVIDPQGNIVEQKSFNVINGFDYHNKLEQREKERNKARQDWTTVGKIKELKQGYLSLVVHEITSMMVKYNAIVVLENLNVGFKRIRSGIAEKAVYQQFEKMLINKLNYLMFKDVEGAKPGSVLNAYQLTDRFESFASMRNQTGFLFYIPAAFTSKIDPATGFVDPFCWSAIKTLDDKKTFISGFDTLKYDNVTGNFILHFEMKKNKDFQKKLEGFMPEWDIVVEANKDRRDAEGKTFISGKRIEFVRENNGHGHYEDYLPCKKLVEILRQYDILFEDGKDVLPLIMKNGDSKLIHEVFKVIRLSLQMRNSNAESGEDFISSPVENNEGICFDSRLGVETLPKDADANGAYHIALKGLLLLEKIRHDERKLGISNSEWLNHIQSLRG

SEQ ID NO: 116 - protein, 1287 aa, Coprococcus eutactus
  Cpf1 (1)..(1287)
MNNNTNNSFEPFIGGNSVSKTLRNELRVGSEYTGKHIKECAIIAEDAVKAENQYIVKEMMDDFYRDFINRKLDALQGINWEQLFDIMKKAKLDKSNKVSKELDKIQESTRKEIVKIFSSDPIYKDMLKADMISKILPEYIVDKYGDAASRIEAVKVFYGFSGYFIDFWASRKNVFSDKNIASAIPHRIVNVNARIHLDNITAFNRIAEIAGDEVAGIAEDACAYLQNMSLEDVFTGACYGEFICQKDIDRYNNICGVINQHMNQYCQNKKISRSKFKMERLHKQILCRSESGFEIPIGFQTDGEVIDAINSFSTILEEKDILDRLRTLSQEVTGYDMERIYVSSKAFESVSKYIDHKWDVIASSMYNYFSGAVRGKDDKKDAKIQTEIKKIKSCSLLDLKKLVDMYYKMDGMCLEHEATEYVAGITEILVDFNYKTFDMDDSVKMIQNEHMINEIKEYLDTYMSIYHWAKDFMIDELVDRDMEFYSELDEIYYDLSDIVPLYNKVRNYVTQKPYSQDKIKLNFGSPTLANGWSKSKEFDNNVVVLLRDEKIYLAILNVGNKPSKDIMAGEDRRRSDTDYKKMNYYLLPGASKTLPHVFISSNAWKKSHGIPDEIMYGYNQNKHLKSSPNFDLEFCRKLIDYYKECIDSYPNYQIFNFKFAATETYNDISEFYKDVERQGYKIEWSYISEDDINQMDRDGQIYLFQIYNKDFAPNSKGMQNLHTLYLKNIFSEENLSDVVIKLNGEAELFFRKSSIQHKRGHKKGSVLVNKTYKTTEKTENGQGEIEVIESVPDQCYLELVKYWSEGGVGQLSEEASKYKDKVSHYAATMDIVKDRRYTEDKFFIHMPITINFKADNRNNVNEKVLKFIAENDDLHVIGIDRGERNLLYVSVIDSRGRIVEQKSFNIVENYESSKNVIRRHDYKGKLVNKEHYRNEARKSWKEIGKIKEIKEGYLSQVIHEISKLVLKYNAIIVMEDLNYGFKRGRFKVERQVYQKFETMLINKLAYLVDKSRAVDEPGGLLKGYQLTYVPDNLGELGSQCGIIFYVPAAYTSKIDPVTGFVDVFDFKAYSNAEARLDFINKLDCIRYDASRNKFEIAFDYGNFRTHHTTLAKTSWTIFIHGDRIKKERGSYGWKDEIIDIEARIRKLFEDTDIEYADGHNLIGDINELESPIQKKFVGELFDIIRFTVQLRNSKSEKYDGTEKEYDKIISPVMDEEGVFFTTDSYIRADGTELPKDADANGAYCIALKGLYDVLAVKKYWKEGEKFDRKLLAITNYNWFDFIQNRRF

SEQ ID NO: 117 - protein, 1304 aa, Lachnospira pectinoschiza
  Cpf1 (1)..(1304)
MNNVTGDFSEFVAISKVQKTLRNELRPTPLTMKHIKQKGIITEDEYKTQQSLELKRIADGYYRDYITHKLNDTNNLDFRNLFEAIEEKYKKNDKDNRDKLDLVEKSKRGEIAKLLSADDNFKSMFEAKLITQLLPVYVEQNYIGEDKEKALETIALFKGFTTYFTDYFNIRKNMFKENGGASSICYRIVNVNASIFYDNLKTFMCIKEKAETEIALIEEELTELLDSWRLEHIFSEDYYNELLAQKGIDYYNQICGDVNKHMNLYCQQNKLKANVFKMTKLQKQIMGISEKAFEIPPMYQNDEEVYAAFNGFISRLEEVKLIDRLGNVLQNSNIYDTAKIYINARCYTNVSSYVYGGWGVIESAIERYWYNTIAGKGQSKAKKIEKAKKDNKFMSVKELDSIVSDYEPDYFNASNMDDDNSGRAFSGHGVLGYFNKMSKLLANMSLHTITYDSGDSLIENKETALNIKKDLDDIMSIYHWLQTFIIDEVVEKDNAFYAELEDIYYELENVVTLYDRIRNYVTRKPYSTQKFKLNFASPTLASGWSRSKEFDNNAIILLRNNKYYIAIFNVNNKPDKQIIKGSEEQRLSTDYKKMVYNLLPGPNKMLPWVFIKSNTGKRDYNPSSYILEGYEKNRHIKSSGNFDINYCHDLIDYYKACINKHPEWKNYGFKFKETTQYNDIGQFYKDVEKQGYSISWAYISEADINRLDEEGKIYLFEIYNKDLSSHSTGKDNLHTMYLKNIFSEDNLKNICIELNGNAELFYRKSSMKRNITHKKDTVLVNKTYINEAGVRVSLTDEDYIKVYNYYNNDYVIDVEKDKKLVEILERIGHRKNPIDIIKDKRYTEDKYFLHFPITINYGVDDENINAKMIEYIAKHNNMNVIGIDRGERNLIYISVINNKGNIIEQKSFNLVNNYDYKNKLKNMEKTRDNARKNWQEIGKIKDVKNGYLSGVISKIARMVVDYNAIIVMEDLNRGFKRGRFKVERQVYQKFENMLISKLNYLVFKEKKADENGGILKGYQLTYLPKSALQIGKQCGCIFYVPAAYTSKIDPATGFINIFDFKKYSGSAINAKVKDKKEFLMSMNSIRYVNEGSAEYEKIGHRQLFAFSFDYNNFKTYNVSIPVNEWTTYTYGERIKKLYKDGRWSGSEVLNLTEDLIELMEQYGIEYKDGHDIREDISHMDEMRNADFICNLFEKFKYTVQLRNSKSEAEGDDYDRLVSPVLNSHNGFFDSSDYKENEKSDDIIDDKQIMPKDADANGAYCIALKGLYEINKIKENWSDDKKLKESELYIGVTEWLDYIQNRRFE

SEQ ID NO: 118 - protein, 1342 aa, Candidatus Ryanbacteria bacterium RIFCSPHIGHO2_01_FULL_48_27
  Cpf1 (1)..(1342)
MANEKKEKSIFDEFTGKYSLSKTLKFELRPVGKTLENMRQHLGYDKNLQTFLADQKIEDAYQSLKPIFDFLHEKFITESLESDVARKIDFTEYFEKYKRRKDLSEKDFVGVEKSLRDEFLKAYDETAESLRIKAGKNEKGKFILSENGHKILTEHGILEYIKKNIDEFVEITPEREIEKSLAAFEGFFTYFGGFNQNRENYYETKKETATSVATRVIHENLPKFCDNILAFDGRSRDYKNAYSILQKLGRTLVDKEGKELIPIEENIFKIEYFNSCMSQRGVEKYNDQIGNANFLINLYNQAKKEENGFKKLPLLKTLYKQIGCGEKRSLFFAINYDQADECKKQENNTEIRSLEEVLNLANKAGKKYFKGKSDDGMINTLPEFLEYLKNRENYLGVYWSKTALNTISSKYFTNWHTLKERLKEAKVFKKAGKDSEEEIMIPEAVELEGFFSVLDVVENWKDEGVLFKQNLTEAQKGAQGEDKNKARKDIILNASIPSEALLNLIFLGIEQHAKAFLDRAPEVLALKEYKNATSKEVIKSWMDHALSITQMLKYFLVKESKVKGTALDSTISQALEVFLQSDDADWFGWYDALRNYLTKKPQDDLKENKLKLNFENSTLASGWDVSKEPDNYCVIFQNPEGEKFLAIIARKKDRKGFNKIFEKNNHNRLYTVSGNKNWKKIEYKLLPGPNKMLPKCLMPKSDRFKYGATQEILDIYDEGSFKKNEVSFSIQKLYKMIDFYKMALERYKDWGCFNFSFQETSKYQDISQFYNDVEKQGYKLDVVDINKSIVDSLVEDGSIYLFEIKNQDSNQGKKENHRDNLHTIYWRAVFESVENRPKLNGGAEIFYRKALLPEKLERNEDRKGKKIIKNPRFSKEKFLFHVPITLNFSSKNTRINDLVNDILSRYGDVHFLGIDRGEKHLAYYSLVDQNGRIKDHGTLNIPFLDKDGNSRMVRAKKRTLGKDGKEQIEMVECKDYNELLDARAGDRDYARKNWQTIGTIKDLKDGYISQVVRTIADLALANNAFIVLESLDTGFKRGRQKIEKSVYQKLELALAKKLNFLVDKKAKFGEIGSVTNALQLTPPVANYGDIENRKQLGVMLYVKADYTSQTDPITGWRKSIYLKKGSEEYIRSQIRDGFSDISFDGKDYVFTYEDKNTHKQWKLYSGKNGKSLDRYHREKGETRNSWDPIRKDVTEMLNGIFENFNRSNSIHSQIVDEGVELKKIDSAHTAWESLRFTIDLIQQIRNTGTAKEDDDFILSPVRDENGNHFDSRKTIKYQPNSGDANGAYNIARKGIVLNEHIKRGYRLFISDEEWDAWLAGKERWEKWISDHKKDLAKKQTAQ

SEQ ID NO: 119 - protein, 1319 aa, Candidatus Jacksonbacteria bacterium RIFCSPLOWO2_02_FULL_44_20
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEF

SEQ ID NO: 120 - protein, 1341 aa, Candidatus Falkowbacteria bacterium RBG_13_39_14
  Cpf1 (1)..(1341)
MNAEKKCAFNEFTNLYELSKTLKFELKPVGKTKEIIKNFREELEKNNPIQLDKEISIAKQEIKKDLDILHREFVRQSFELAFKENKINYEIFFEIYRNFKKFSKNKKSDEYIAAIKNLKEEKIKLVKKIADYFVKMDQEWRKYYPSEKKSFLLMSNGVINLLIDINKDRMDYSFIPKEVCEKIKGKGKIELYEKFNKHFGYLSKYNTARENFYSDDVKNSASVAYRAICENLEKFCDNKIKVEADNFPKEIKEKFLEYFNKITDLSFYNRCLSQNGIEEYHKFKDEINRSINELYPNNSKNKPQNIPYLSKLDKQILSEKDKQSWIEEGFIDENNFIFEFEKFIKMNDKYIPSEKKLFNEFFIFQNNDEVLQKLFLLKKTINNFANIYLDDPKNLMDLMPSKGTKKRDYLSLLEIKEALNSYAENQNIGETQIFKIKYDDVIDKTKTPFECFMKIWKYEYDLLYNEGDGKKNIEEGWEKICEKLQNKKDEFTGDYGKYKKEIKDYCEMALSLSQRIKHLDIRIKKRDGSEDADNNLFEGVEKLDEFYDRLFEIVDEHNAYQYHHEFQAFLTKKPYKTDKFKLSFDNPQLLKGWDLNKEPDYFGALLVKNEKYFLAVFHKQYANEIFRQKNKNSTVKIKEAYDVFNGNYYKKVELKQIPKLFMNLPRICFAKSNQEEFGLTIELEKIKSEFDKFQKLKKERQDNNLKFDQEKFIKLLAYYRHCLEIREDWKVFKYNFKPLYKYSNLGEFYRDLEKDTYNLDLVRVNSEYVEKKRNEGKLYLFEVYNKDFSDKSIGRKNIHSDYFKSLFLPDNLTNKKIALAADAEIFFREKSLKNKDEIITQKNKIKIDKNNHKGEKAYSKNRYTDDKIILHLPINLNFGENKNHKDFNYEINDSLLKNNRDIKIIGIDRGEKYLLYYSVIDQKGDIKEMGDFNVVNGVDYYSKLVAYEEKRKQARLDWGDIQSIKELKEGYISHVIHEICDLIKKYNAIVVLEDLSMGFKRGRFFRERQVYQKFELALFRKLNYWVDKNKEEGEKGSALSAWQLTPNEKDFKVSQLEKARQLGILFYTAAGYTSKTCPDCGFRKNITLKYVNDKQLKEDLGKLKINFVEDHFKIKYNLLDFEKNKKSEKAKDTVLPKEERKISFVANSKVIRIRWHDIKTKLAKRELDGEKIIKKFPKGVIKEYDINICLKRIIGDKIDFSKDSITEQLINGRFGKDFYWELMYFLNLILEIRNVVSETEIDYIQCPVCGFHSDDGFRGNKFNGDANGAYNIARKGRLILEKINQHKNLKELKTGDLSVNIVEWDKAVNNWDKFVQGDNTESKNIEIPAKEEMISVEVRES

SEQ ID NO: 121 - protein, 998 aa, Arcobacter butzleri
  Cpf1 (1)..(998)
MGLLEHLEGAIVEDMFSLDYFSLTLSQRYIDIYNTMIGGNTLADGTKVQGINENINIYRQKNNIDRKNLPTLKPLHKQLLSDRETLSWIPEAFKTKEEVVGAIEDFYKNNIISFKCCDNIVDITKQFIDIFSLNEDYELNKIFIKNDISITSISQDIFKDYRIIKEALWQKHINENPKAAKSKDLTGDKEKYFSRKNSFFSFEEIISSLKLMGRKIDLFSYFKDNVEYRAHSIETTFIKWQKNKNDKKTTKELLDNILNLQRVLKPLYLKAEVEKDILFYSIFDIYFESLNEIVKLYNKVRDFESKKPYSLEKFKLNFQNSTLLSGWDVNKEPDNTSILLKKDGLYYLGIMDKKHNRVFKNLESSKGGYEKIEYKLLSGPNKMLPKVFFSNKSIGYYNPSPALLEKYKSGVHKKGESFDLNFCHELIDFFKASIDKHEDWKNFNFKFSDTSEYADISGFYREVEQQGYKITFKNIDEEFINTLINEGKLYLFQIYNKDFSTFSKGTKNLHTLYWEMIFNEENLKNVVYKLNGEAEIFYRKKSIEYSEDKMKYGHHYEELKDKFNYPIIKDKRFTMDKFQFHVPITMNFKATGRSYINEEVNDFLRQNSKDVKIIGINRGERHLIYLTMINAKGEIIQQYSLNEIVNSYNNKNFTVNYNEKLSKKEGERAIARENWGVVENIKELKEGYLSHAIHTISNLIVENNAIVVLEDLNFEFKRERLKVEKSIYQKFEKMLIDKLNYLVDKKKDINENGGLLKALQLTNKFESFEKIGKQNGFLFFVNAWNITKICPVTGFVSLFDTRYQSVDKAREFFSKFDSIKYNEEKEHYEFVFDYSNFTDKAKDTKTKWTVCSYGTRIKTFRNSEKNNNWDNKTVSPTEDLSKLLKSCDRDIKEFIISQDKKEFFVELLEIFSLIVQMKNSIINSEIDYIISPVANENGEFFDSRFANSSLPKNADANAAYNTARKGLMLLEKIRDSEIGKKIDMKITNTEWLNFVQER

SEQ ID NO: 122 - protein, 1475 aa, Treponema endosymbiont of Eucomonympha sp.
  Cpf1 (1)..(1475)
MTAFEELTNLYSVSKTLRFELKPAGKDGNTLSAEESAKLFKEILDQDRKIKDAYLALKPVMDTIHEKIINSSLGSDEARQIDFSAYYIEYNKKDNEYAVKKAEESLRAAIRSAFDKAANELAKNAGNDEKGKPIFKKKKGKDVGVEYLTQAGIIKYIENHIKTLVPQKVKEFIDKKNVINAKGKKITERTGHLAVFDSFFTYFGGYNTNRKNYYTEDKEKATAVATRIVHDNLPKFCDNCIQFSQDKIVTKRKSKETIPARKDEYLNAYQFLKDSEKTTQIKDAATNTMIEAYPVDERTFEIARFSECLTQAGIEEYNRIIGHYNSLINLYNQTRKGESDFRKLEQFKTLHKQIGCGEKKGWRDALKDNEDLKGKLKAISEAGQKYFTASLNPDDITFFSFIDWLKKNEDWDGVYWSKSAVDKVSGVYFANWHDIKDRLKGNKACVHLDKNKELQINDAVELSGLFAVINSGNSESADIHAQEHGLFDALNQENNEDLSKTLFKQSVLDEKASLIDEKLSASKNLINLICADMENLANAFCETSAEIMKITDFKNEANILSIKNWLDTAKSLIWRVKDFDIKESKRKGNAINAELSNMLTELLHADDARWFDWYDLVRNYLTKKPQDDAKANKLKLNFGYGKLLDGFVDSHTDESDASTQYGGYLFRKRTDAQEKSDFEYFLGISKNTKLFRCHLQSTVQNHDKSNFERLEYYQAKSTTYFDAKYSENKAKLVEIIESLIDDRAKTDSELTVIGNEIKKRDGKGEITPSALFDRVKKDKAFSRILNDDTLLKAVTQAIRDLQNSCDNFSERAPRLKEVQKRGYFGIVGFKQIVEDLQTVAKENKVFNFFNVSQPEFENAFISGGKRIYLFKISNKDLSYSETSQKDENGQQKRNFKGIENLHTHYFRALMREYKNCTNVDLGKGEIFFRAPVPEIKKEATHKVYDKMVNRRENETHIAIPEKVHNELLLFANEKIAVNNLSNETKLYLDQNKKIDESRVKIKDVKHDIIKDKRFTEAKYQLHLSILLNFTPTKEEVNAKINDTFTKSDDIQFLGIDRGEKHLIYYSLVDANGTIRAQDHFDVINKTDYLQKITEAAKIRREKQENWQQKGNISNLKDGYISLVVHEIIEKMKDENGSFKPMFIVLEDLNTGFKRSRQKFEQQVYQKFELALAKKLNYLVDKNAKDGELASVSRALQLTPLVMNYQDIENRKQVGIMLYTRANYTSVTDPATGWRKTVYLKPGSEESIKKQILGVFSEIGVDEKGDYFFQYSDTNTERTWRLWSSKNGKSLERYRGRRDKNTNAFTVEPYDVKATLNKLFVGFDKDMSLLKQLKDGKTLSKIDGRKETAWESLRFVIDLIQQIRNSGDTSKNQDDNFLLSPVRNAQGEHFDSRLYQNQETPKLPKDADANGAYNIARKGIIMYAHIRQWINDGGQRFEKSSDLDLFVSDNEWDLWLFDSKQWKEQLQKFASRKQKK

SEQ ID NO: 123 - protein, 1262 aa, Bacteroidetes oral taxon 274 str. F0058
  Cpf1 (1)..(1262)
MRKFNEFVGLYPISKTLRFELKPIGKTLEHIQRNKLLEHDAVRADDYVKVKKIIDKYHKCLIDEALSGFTFDTEADGRSNNSLSEYYLYYNLKKRNEQEQKTFKTIQNNLRKQIVNKLTQSEKYKRIDKKELITTDLPDFLTNESEKELVEKFKNFTTYFTEFHKNRKNMYSKEEKSTAIAFRLINENLPKFVDNIAAFEKVVSSPLAEKINALYEDFKEYLNVEEISRVFRLDYYDELLTQKQIDLYNAIVGGRTEEDNKIQIKGLNQYINEYNQQQTDRSNRLPKLKPLYKQILSDRESVSWLPPKFDSDKNLLIKIKECYDALSEKEKVFDKLESILKSLSTYDLSKIYISNDSQLSYISQKMFGRWDIISKAIREDCAKRNPQKSRESLEKFAERIDKKLKTIDSISIGDVDECLAQLGETYVKRVEDYFVAMGESEIDDEQTDTTSFKKNIEGAYESVKELLNNADNITDNNLMQDKGNVEKIKTLLDAIKDLQRFIKPLLGKGDEADKDGVFYGEFTSLWTKLDQVTPLYNMVRNYLTSKPYSTKKIKLNFENSTLMDGWDLNKEPDNTTVIFCKDGLYYLGIMGKKYNRVFVDREDLPHDGECYDKMEYKLLPGANKMLPKVFFSETGIQRFLPSEELLGKYERGTHKKGAGFDLGDCRALIDFFKKSIERHDDWKKFDFKFSDTSTYQDISEFYREVEQQGYKMSFRKVSVDYIKSLVEEGKLYLFQIYNKDFSAHSKGTPNMHTLYWKMLFDEENLKDVVYKLNGEAEVFFRKSSITVQSPTHPANSPIKNKNKDNQKKESKFEYDLIKDRRYTVDKFLFHVPITMNFKSVGGSNINQLVKRHIRSATDLHIIGIDRGERHLLYLTVIDSRGNIKEQFSLNEIVNEYNGNTYRTDYHELLDTREGERTEARRNWQTIQNIRELKEGYLSQVIHKISELAIKYNAVIVLEDLNFGFMRSRQKVEKQVYQKFEKMLIDKLNYLVDKKKPVAETGGLLRAYQLTGEFESFKTLGKQSGILFYVPAWNTSKIDPVTGFVNLFDTHYENIEKAKVFFDKFKSIRYNSDKDWFEFVVDDYTRFSPKAEGTRRDWTICTQGKRIQICRNHQRNNEWEGQEIDLTKAFKEHFEAYGVDISKDLREQINTQNKKEFFEELLRLLRLTLQMRNSMPSSDIDYLISPVANDTGCFFDSRKQAELKENAVLPMNADANGAYNIARKGLLAIRKMKQEENDSAKISLAISNKEWLKFAQTKPYLED

SEQ ID NO: 124 - protein, 1231 aa, Butyrivibrio fibrisolvens
  Cpf1 (1)..(1231)
MYYESLTKLYPIKKTIRNELVPIGKTLENIKKNNILEADEDRKIAYIRVKAIMDDYHKRLINEALSGFALIDLDKAANLYLSRSKSADDIESFSRFQDKLRKAIAKRLREHENFGKIGNKDIIPLLQKLSENEDDYNALESFKNFYTYFESYNDVRLNLYSDKEKSSTVAYRLINENLPRFLDNIRAYDAVQKAGITSEELSSEAQDGLFLVNTFNNVLIQDGINTYNEDIGKLNVAINLYNQKNASVQGFRKVPKMKVLYKQILSDREESFIDEFESDTELLDSLESHYANLAKYFGSNKVQLLFTALRESKGVNVYVKNDIAKTSFSNVVFGSWSRIDELINGEYDDNNNRKKDEKYYDKRQKELKKNKSYTIEKIITLSTEDVDVIGKYIEKLESDIDDIRFKGKNFYEAVLCGHDRSKKLSKNKGAVEAIKGYLDSVKDFERDLKLINGSGQELEKNLVVYGEQEAVLSELSGIDSLYNMTRNYLTKKPFSTEKIKLNFNKPTFLDGWDYGNEEAYLGFFMIKEGNYFLAVMDANWNKEFRNIPSVDKSDCYKKVIYKQISSPEKSIQNLMVIDGKTVKKNGRKEKEGIHSGENLILEELKNTYLPKKINDIRKRRSYLNGDTFSKKDLTEFIGYYKQRVIEYYNGYSFYFKSDDDYASFKEFQEDVGRQAYQISYVDVPVSFVDDLINSGKLYLFRVYNKDFSEYSKGRLNLHTLYFKMLFDERNLKNVVYKLNGQAEVFYRPSSIKKEELIVHRAGEEIKNKNPKRAAQKPTRRLDYDIVKDRRYSQDKFMLHTSIIMNFGAEENVSFNDIVNGVLRNEDKVNVIGIDRGERNLLYVVVIDPEGKILEQRSLNCITDSNLDIETDYHRLLDEKESDRKIARRDWTTIENIKELKAGYLSQVVHIVAELVLKYNAIICLEDLNFGFKRGRQKVEKQVYQKFEKMLIDKLNYLVMDKSREQLSPEKISGALNALQLTPDFKSFKVLGKQTGIIYYVPAYLTSKIDPMTGFANLFYVKYENVDKAKEFFSKFDSIKYNKDGKNWNTKGYFEFAFDYKKFTDRAYGRVSEWTVCTVGERIIKFKNKEKNNSYDDKVIDLTNSLKELFDSYKVTYESEVDLKDAILAIDDPAFYRDLTRRLQQTLQMRNSSCDGSRDYIISPVKNSKGEFFCSDNNDDTTPNDADANGAFNIARKGLWVLNEIRNSEEGSKINLAMSNAQWLEYAQDNTI

SEQ ID NO: 125 - protein, 1230 aa, Lachnospiraceae bacterium COE1
  Cpf1 (1)..(1230)
MHENNGKIADNFIGIYPVSKTLRFELKPVGKTQEYIEKHGILDEDLKRAGDYKSVKKIIDAYHKYFIDEALNGIQLDGLKNYYELYEKKRDNNEEKEFQKIQMSLRKQIVKRFSEHPQYKYLFKKELIKNVLPEFTKDNAEEQTLVKSFQEFTTYFEGFHQNRKNMYSDEEKSTAIAYRVVHQNLPKYIDNMRIFSMILNTDIRSDLTELFNNLKTKMDITIVEEYFAIDGFNKVVNQKGIDVYNTILGAFSTDDNTKIKGLNEYINLYNQKNKAKLPKLKPLFKQILSDRDKISFIPEQFDSDTEVLEAVDMFYNRLLQFVIENEGQITISKLLTNFSAYDLNKIYVKNDTTISAISNDLFDDWSYISKAVRENYDSENVDKNKRAAAYEEKKEKALSKIKMYSIEELNFFVKKYSCNECHIEGYFERRILEILDKMRYAYESCKILHDKGLINNISLCQDRQAISELKDFLDSIKEVQWLLKPLMIGQEQADKEEAFYTELLRIWEELEPITLLYNKVRNYVTKKPYTLEKVKLNFYKSTLLDGWDKNKEKDNLGIILLKDGQYYLGIMNRRNNKIADDAPLAKTDNVYRKMEYKLLTKVSANLPRIFLKDKYNPSEEMLEKYEKGTHLKGENFCIDDCRELIDFFKKGIKQYEDWGQFDFKFSDTESYDDISAFYKEVEHQGYKITFRDIDETYIDSLVNEGKLYLFQIYNKDFSPYSKGTKNLHTLYWEMLFSQQNLQNIVYKLNGNAEIFYRKASINQKDVVVHKADLPIKNKDPQNSKKESMFDYDIIKDKRFTCDKYQFHVPITMNFKALGENHFNRKVNRLIHDAENMHIIGIDRGERNLIYLCMIDMKGNIVKQISLNEIISYDKNKLEHKRNYHQLLKTREDENKSARQSWQTIHTIKELKEGYLSQVIHVITDLMVEYNAIVVLEDLNFGFKQGRQKFERQVYQKFEKMLIDKLNYLVDKSKGMDEDGGLLHAYQLTDEFKSFKQLGKQSGFLYYIPAWNTSKLDPTTGFVNLFYTKYESVEKSKEFINNFTSILYNQEREYFEFLFDYSAFTSKAEGSRLKWTVCSKGERVETYRNPKKNNEWDTQKIDLTFELKKLFNDYSISLLDGDLREQMGKIDKADFYKKFMKLFALIVQMRNSDEREDKLISPVLNKYGAFFETGKNERMPLDADANGAYNIARKGLWIIEKIKNTDVEQLDKVKLTISNKEWLQYAQEHIL

SEQ ID NO: 126 - protein, 1318 aa, Flavobacterium branchiophilum FL-15
  Cpf1 (1)..(1318)
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 127 - protein, 1273 aa, Flavobacterium sp. 316
  Cpf1 (1)..(1273)
MKNFSNLYQVSKTVRFELKPIGNTLENIKNKSLLKNDSIRAESYQKMKKTIDEFHKYFIDLALNNKKLSYLNEYIALYTQSAEAKKEDKFKADFKKVQDNLRKEIVSSFTEGEAKAIFSVLDKKELITIELEKWKNENNLAVYLDESFKSFTTYFTGFHQNRKNMYSAEANSTAIAYRLIHENLPKFIENSKAFEKSSQIAELQPKIEKLYKEFEAYLNVNSISELFEIDYFNEVLTQKGITVYNNIIGGRTATEGKQKIQGLNEIINLYNQTKPKNERLPKLKQLYKQILSDRISLSFLPDAFTEGKQVLKAVFEFYKINLLSYKQDGVEESQNLLELIQQVVKNLGNQDVNKIYLKNDTSLTTIAQQLFGDFSVFSAALQYRYETVVNPKYTAEYQKANEAKQEKLDKEKIKFVKQDYFSIAFLQEVVADYVKTLDENLDWKQKYTPSCIADYFTTHFIAKKENEADKTFNFIANIKAKYQCIQGILEQADDYEDELKQDQKLIDNIKFFLDAILEVVHFIKPLHLKSESITEKDNAFYDVFENYYEALNVVTPLYNMVRNYVTQKPYSTEKIKLNFENAQLLNGWDANKEKDYLTTILKRDGNYFLAIMDKKHNKTFQQFTEDDENYEKIVYKLLPGVNKMLPKVFFSNKNIAFFNPSKEILDNYKNNTHKKGATFNLKDCHALIDFFKDSLNKHEDWKYFDFQFSETKTYQDLSGFYKEVEHQGYKINFKKVSVSQIDTLIEEGKMYLFQIYNKDFSPYAKGKPNMHTLYWKALFETQNLENVIYKLNGQAEIFFRKASIKKKNIITHKAHQPIAAKNPLTPTAKNTFAYDLIKDKRYTVDKFQFHVPITMNFKATGNSYINQDVLAYLKDNPEVNIIGLDRGERHLVYLTLIDQKGTILLQESLNVIQDEKTHTPYHTLLDNKEIARDKARKNWGSIESIKELKEGYISQVVHKITKMMIEHNAIVVMEDLNFGFKRGRFKVEKQIYQKLEKMLIDKLNYLVLKDKQPHELGGLYNALQLTNKFESFQKMGKQSGFLFYVPAWNTSKIDPTTGFVNYFYTKYENVEKAKTFFSKFDSILYNKTKGYFEFVVKNYSDFNPKAADTRQEWTICTHGERIETKRQKEQNNNFVSTTIQLTEQFVNFFEKVGLDLSKELKTQLIAQNEKSFFEELFHLLKLTLQMRNSESHTEIDYLISPVANEKGIFYDSRKATASLPIDADANGAYHIAKKGLWIMEQINKTNSEDDLKKVKLAISNREWLQYVQQVQKK

SEQ ID NO: 128 - protein, 1214 aa, Candidate division WS6 bacterium GW2011_GWA2_37_6 US52_C0007
  Cpf1 (1)..(1214)
MKNVFGGFTNLYSLTKTLRFELKPTSKTQKLMKRNNVIQTDEEIDKLYHDEMKPILDEIHRRFINDALAQKIFISASLDNFLKVVKNYKVESAKKNIKQNQVKLLQKEITIKTLGLRREVVSGFITVSKKWKDKYVGLGIKLKGDGYKVLTEQAVLDILKIEFPNKAKYIDKFRGFWTYFSGFNENRKNYYSEEDKATSIANRIVNENLSRYIDNIIAFEEILQKIPNLKKFKQDLDITSYNYYLNQAGIDKYNKIIGGYIVDKDKKIQGINEKVNLYTQQTKKKLPKLKFLFKQIGSERKGFGIFEIKEGKEWEQLGDLFKLQRTKINSNGREKGLFDSLRTMYREFFDEIKRDSNSQARYSLDKIYFNKASVNTISNSWFTNWNKFAELLNIKEDKKNGEKKIPEQISIEDIKDSLSIIPKENLEELFKLTNREKHDRTRFFGSNAWVTFLNIWQNEIEESFNKLEEKEKDFKKNAAIKFQKNNLVQKNYIKEVCDRMLAIERMAKYHLPKDSNLSREEDFYWIIDNLSEQREIYKYYNAFRNYISKKPYNKSKMKLNFENGNLLGGWSDGQERNKAGVILRNGNKYYLGVLINRGIFRTDKINNEIYRTGSSKWERLILSNLKFQTLAGKGFLGKHGVSYGNMNPEKSVPSLQKFIRENYLKKYPQLTEVSNTKFLSKKDFDAAIKEALKECFTMNFINIAENKLLEAEDKGDLYLFEITNKDFSGKKSGKDNIHTIYWKYLFSESNCKSPIIGLNGGAEIFFREGQKDKLHTKLDKKGKKVFDAKRYSEDKLFFHVSITINYGKPKNIKFRDIINQLITSMNVNIIGIDRGEKHLLYYSVIDSNGIILKQGSLNKIRVGDKEVDFNKKLTERANEMKKARQSWEQIGNIKNFKEGYLSQAIHEIYQLMIKYNAIIVLEDLNTEFKAKRLSKVEKSVYKKFELKLARKLNHLILKDRNTNEIGGVLKAYQLTPTIGGGDVSKFEKAKQWGMMFYVRANYTSTTDPVTGWRKHLYISNFSNNSVIKSFFDPTNRDTGIEIFYSGKYRSWGFRYVQKETGKKWELFATKELERFKYNQTTKLCEKINLYDKFEELFKGIDKSADIYSQLCNVLDFRWKSLVYLWNLLNQIRNVDKNAEGNKNDFIQSPVYPFFDSRKTDGKTEPINGDANGALNIARKGLMLVERIKNNPEKYEQLIRDTEWDAWIQNFNKVN

SEQ ID NO: 129 - protein, 1310 aa, Helcococcus kunzii ATCC 51366
  Cpf1 (1)..(1310)
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKGGYYYLGILIDNKLLINKKNKSKKIYEILIYNQIPEFSKSIPNYPFTKKVKEHFKNNVSDFQLIDGYVSPLIITKEIYDIKKEKKYKKDFYKDNNTNKNYLYTIYKWIEFCKQFLYKYKGPNKESYKEMYDFSTLKDTSLYVNLNDFYADVNSCAYRVLFNKIDENTIDNAVEDGKLLLFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDERKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 130 - protein, 1206 aa, Lachnospiraceae bacterium NC2008
  Cpf1 (1)..(1206)
MENYYDSLTRQYPVTKTIRQELKPVGKTLENIKNAEIIEADKQKKEAYVKVKELMDEFHKSIIEKSLVGIKLDGLSEFEKLYKIKTKTDEDKNRISELFYYMRKQIADALKNSRDYGYVDNKDLIEKILPERVKDENSLNALSCFKGFTTYFTDYYKNRKNIYSDEEKHSTVGYRCINENLLIFMSNIEVYQIYKKANIKNDNYDEETLDKTFMIESFNECLTQSGVEAYNSVVASIKTATNLYIQKNNKEENFVRVPKMKVLFKQILSDRTSLFDGLIIESDDELLDKLCSFSAEVDKFLPINIDRYIKTLMDSNNGTGIYVKNDSSLTTLSNYLTDSWSSIRNAFNENYDAKYTGKVNDKYEEKREKAYKSNDSFELNYIQNLLGINVIDKYIERINFDIKEICEAYKEMTKNCFEDHDKTKKLQKNIKAVASIKSYLDSLKNIERDIKLLNGTGLESRNEFFYGEQSTVLEEITKVDELYNITRNYLTKKPFSTEKMKLNFNNPQLLGGWDVNKERDCYGVILIKDNNYYLGIMDKSANKSFLNIKESKNENAYKKVNCKLLPGPNKMFPKVFFAKSNIDYYDPTHEIKKLYDKGTFKKGNSFNLEDCHKLIDFYKESIKKNDDWKNFNFNFSDTKDYEDISGFFREVEAQNYKITYTNVSCDFIESLVDEGKLYLFQIYNKDFSEYATGNLNLHTLYLKMLFDERNLKDLCIKMNGEAEVFYRPASILDEDKVVHKANQKITNKNTNSKKKESIFSYDIVKDKRYTVDKFFIHLPITLNYKEQNVSRFNDYIREILKKSKNIRVIGIDRGERNLLYVVVCDSDGSILYQRSINEIVSGSHKTDYHKLLDNKEKERLSSRRDWKTIENIKDLKAGYMSQVVNEIYNLILKYNAIVVLEDLNIGFKNGRKKVEKQVYQNFEKALIDKLNYLCIDKTREQLSPSSPGGVLNAYQLTAKFESFEKIGKQTGCIFYVPAYLTSQIDPTTGFVNLFYQKDTSKQGLQLFFRKFKKINFDKVASNFEFVFDYNDFTNKAEGTKTNWTISTQGTRIAKYRSDDANGKWISRTVHPTDIIKEALNREKINYNDGHDLIDEIVSIEKSAVLKEIYYGFKLTLQLRNSTLANEEEQEDYIISPVKNSSGNYFDSRITSKELPCDADANGAYNIARKGLWALEQIRNSENVSKVKLAISNKEWFEYTQNNIPSL

SEQ ID NO: 131 - protein, 1224 aa, Lachnospiraceae bacterium MC2017
  Cpf1 (1)..(1224)
MGLYDGFVNRYSVSKTLRFELIPQGRTREYIETNGILSDDEERAKDYKTIKRLIDEYHKDYISRCLKNVNISCLEEYYHLYNSSNRDKRHEELDALSDQMRGEIASFLTGNDEYKEQKSRDIIINERIINFASTDEELAAVKRFRKFTSYFTGFFTNRENMYSAEKKSTAIAHRIIDVNLPKYVDNIKAFNTAIEAGVFDIAEFESNFKAITDEHEVSDLLDITKYSRFIRNEDIIIYNTLLGGISMKDEKIQGLNELINLHNQKHPGKKVPLLKVLYKQILGDSQTHSFVDDQFEDDQQVINAVKAVTDTFSETLLGSLKIIINNIGHYDLDRIYIKAGQDITTLSKRALNDWHIITECLESEYDDKFPKNKKSDTYEEMRNRYVKSFKSFSIGRLNSLVTTYTEQACFLENYLGSFGGDTDKNCLTDFTNSLMEVEHLLNSEYPVTNRLITDYESVRILKRLLDSEMEVIHFLKPLLGNGNESDKDLVFYGEFEAEYEKLLPVIKVYNRVRNYLTRKPFSTEKIKLNFNSPTLLCGWSQSKEKEYMGVILRKDGQYYLGIMTPSNKKIFSEAPKPDEDCYEKMVLRYIPHPYQMLPKVFFSKSNIAFFNPSDEILRIKKQESFKKGKSFNRDDCHKFIDFYKDSINRHEEWRKFNFKFSDTDSYEDISRFYKEVENQAFSMSFTKIPTVYIDSLVDEGKLYLFKLHNKDFSEHSKGKPNLHTVYWNALFSEYNLQNTVYQLNGSAEIFFRKASIPENERVIHKKNVPITRKVAELNGKKEVSVFPYDIIKNRRYTVDKFQFHVPLKMNFKADEKKRINDDVIEAIRSNKGIHVIGIDRGERNLLYLSLINEEGRIIEQRSLNIIDSGEGHTQNYRDLLDSREKDREKARENWQEIQEIKDLKTGYLSQAIHTITKWMKEYNAIIVLEDLNDRFTNGRKKVEKQVYQKFEKMLIDKLNYYVDKDEEFDRMGGTHRALQLTEKFESFQKLGRQTGFIFYVPAWNTSKLDPTTGFVDLLYPKYKSVDATKDFIKKFDFIRFNSEKNYFEFGLHYSNFTERAIGCRDEWILCSYGNRIVNFRNAAKNNSWDYKEIDITKQLLDLFEKNGIDVKQENLIDSICEMKDKPFFKSLIANIKLILQIRNSASGTDIDYMISPAMNDRGEFFDTRKGLQQLPLDADANGAYNIAKKGLWIVDQIRNTTGNNVKMAMSNREWMHFAQESRLA

SEQ ID NO: 132 - protein, 1227 aa, Candidatus Methanomethylophilus alvus Mx1201
  Cpf1 (1)..(1227)
MDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPKIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 133 - protein, 1264 aa, Moraxella caprae DSM 19149
  Cpf1 (1)..(1264)
MLFQDFTHLYPLSKTMRFELKPIGKTLEHIHAKNFLSQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAITYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGALYDELAKIPTLYNKVRDYLSQKPFSTEKYKLNFGNPTLLNGWDLNKEKDNFGIILQKDGCYYLALLDKAHKKVFDNAPNTGKNVYQKMIYKLLPGPNKMLPKVFFAKSNLDYYNPSAELLDKYAQGTHKKGNNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSKDNLANPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDEADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWKICSHGDKRYVYDKTANQNKGATKGINVNDELKSLFARHHINDKQPNLVMDICQNNDKEFHKSLIYLLKTLLALRYSNASSDEDFILSPVANDEGMFFNSALADDTQPQNADANGAYHIALKGLWVLEQIKNSDDLNKVKLAIDNQTWLNFAQNR

SEQ ID NO: 134 - protein, 1057 aa, Microgenomates (Roizmanbacteria) bacterium GW2011_GWA2_37_7
  Csm1 (1)..(1057)
  RuvCI_active_site (696)..(696)
  RuvCII_active_site (922)..(922)
  RuvCIII_active_site (1040)..(1040)
MEIQELKNLYEVKKTVRFELKPSKKKIFEGGDVIKLQKDFEKVQKFFLDIFVYKNEHTKLEFKKKREIKYTWLRTNTKNEFYNWRGKSDTGKNYALNKIGFLAEEILRWLNEWQELTKSLKDLTQREEHKQERKSDIAFVLRNFLKRQNLPFIKDFFNAVIDIQGKQGKESDDKIRKFREEIKEIEKNLNACSREYLPTQSNGVLLYKASFSYYTLNKTPKEYEDLKKEKESELSSVLLKEIYRRKRFNRTTNQKDTLFECTSDWLVKIKLGKDIYEWTLDEAYQKMKIWKANQKSNFIEAVAGDKLTHQNFRKQFPLFDASDEDFETFYRLTKALDKNPENAKKIAQKRGKFFNAPNETVQTKNYHELCELYKRIAVKRGKIIAEIKGIENEEVQSQLLTHWAVIAEERDKKFIVLIPRKNGGKLENHKNAHAFLQEKDRKEPNDIKVYHFKSLTLRSLEKLCFKEAKNTFAPEIKKETNPKIWFPTYKQEWNSTPERLIKFYKQVLQSNYAQTYLDLVDFGNLNTFLETHFTTLEEFESDLEKTCYTKVPVYFAKKELETFADEFEAEVFEITTRSISTESKRKENAHAEIWRDFWSRENEEENHITRLNPEVSVLYRDEIKEKSNTSRKNRKSNANNRFSDPRFTLATTITLNADKKKSNLAFKTVEDINIHIDNFNKKFSKNFSGEWVYGIDRGLKELATLNVVKFSDVKNVFGVSQPKEFAKIPIYKLRDEKAILKDENGLSLKNAKGEARKVIDNISDVLEEGKEPDSTLFEKREVSSIDLTRAKLIKGHIISNGDQKTYLKLKETSAKRRIFELFSTAKIDKSSQFHVRKTIELSGTKIYWLCEWQRQDSWRTEKVSLRNTLKGYLQNLDLKNRFENIETIEKINHLRDAITANMVGILSHLQNKLEMQGVIALENLDTVREQSNKKMIDEHFEQSNEHVSRRLEWALYCKFANTGEVPPQIKESIFLRDEFKVCQIGILNFIDVKGTSSNCPNCDQESRKTGSHFICNFQNNCIFSSKENRNLLEQNLHNSDDVAAFNIAKRGLEIVKV

SEQ ID NO: 135 - protein, 1206 aa, Butyrivibrio sp. NC3005
  Cpf1 (1)..(1206)
MYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 136 - protein, 1222 aa, Oribacterium sp. NK2B42
  Cpf1 (1)..(1222)
METEILKYDFFEREGKYMYYDGLTKQYALSKTIRNELVPIGKTLDNIKKNRILEADIKRKSDYEHVKKLMDMYHKKIINEALDNFKLSVLEDAADIYFNKQNDERDIDAFLKIQDKLRKEIVEQLKGHTDYSKVGNKDFLGLLKAASTEEDRILIESFDNFYTYFTSYNKVRSNLYSAEDKSSTVAYRLINENLPKFFDNIKAYRTVRNAGVISGDMSIVEQDELFEVDTFNHTLTQYGIDTYNHMIGQLNSAINLYNQKMHGAGSFKKLPKMKELYKQLLTEREEEFIEEYTDDEVLITSVHNYVSYLIDYLNSDKVESFFDTLRKSDGKEVFIKNDVSKTTMSNILFDNWSTIDDLINHEYDSAPENVKKTKDDKYFEKRQKDLKKNKSYSLSKIAALCRDTTILEKYIRRLVDDIEKIYTSNNVFSDIVLSKHDRSKKLSKNTNAVQAIKNMLDSIKDFEHDVMLINGSGQEIKKNLNVYSEQEALAGILRQVDHIYNLTRNYLTKKPFSTEKIKLNFNRPTFLDGWDKNKEEANLGILLIKDNRYYLGIMNTSSNKAFVNPPKAISNDIYKKVDYKLLPGPNKMLPKVFFATKNIAYYAPSEELLSKYRKGTHKKGDSFSIDDCRNLIDFFKSSINKNTDWSTFGFNFSDTNSYNDISDFYREVEKQGYKLSFTDIDACYIKDLVDNNELYLFQIYNKDFSPYSKGKLNLHTLYFKMLFDQRNLDNVVYKLNGEAEVFYRPASIESDEQIIHKSGQNIKNKNQKRSNCKKTSTFDYDIVKDRRYCKDKFMLHLPITVNFGTNESGKFNELVNNAIRADKDVNVIGIDRGERNLLYVVVVDPCGKIIEQISLNTIVDKEYDIETDYHQLLDEKEGSRDKARKDWNTIENIKELKEGYLSQVVNIIAKLVLKYDAIICLEDLNFGFKRGRQKVEKQVYQKFEKMLIDKMNYLVLDKSRKQESPQKPGGALNALQLTSAFKSFKELGKQTGIIYYVPAYLTSKIDPTTGFANLFYIKYESVDKARDFFSKFDFIRYNQMDNYFEFGFDYKSFTERASGCKSKWIACTNGERIVKYRNSDKNNSFDDKTVILTDEYRSLFDKYLQNYIDEDDLKDQILQIDSADFYKNLIKLFQLTLQMRNSSSDGKRDYIISPVKNYREEFFCSEFSDDTFPRDADANGAYNIARKGLWVIKQIRETKSGTKINLAMSNSEWLEYAQCNLL

SEQ ID NO: 137 - protein, 1331 aa, Parcubacteria bacterium GW2011
  Cpf1 (1)..(1331)
MKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 138 - protein, 1257 aa, Prevotella bryantii B14
  Cpf1 (1)..(1257)
MQINNLKIIYMKFTDFTGLYSLSKTLRFELKPIGKTLENIKKAGLLEQDQHRADSYKKVKKIIDEYHKAFIEKSLSNFELKYQSEDKLDSLEEYLMYYSMKRIEKTEKDKFAKIQDNLRKQIADHLKGDESYKTIFSKDLIRKNLPDFVKSDEERTLIKEFKDFTTYFKGFYENRENMYSAEDKSTAISHRIIHENLPKFVDNINAFSKIILIPELREKLNQIYQDFEEYLNVESIDEIFHLDYFSMVMTQKQIEVYNAIIGGKSTNDKKIQGLNEYINLYNQKHKDCKLPKLKLLFKQILSDRIAISWLPDNFKDDQEALDSIDTCYKNLLNDGNVLGEGNLKLLLENIDTYNLKGIFIRNDLQLTDISQKMYASWNVIQDAVILDLKKQVSRKKKESAEDYNDRLKKLYTSQESFSIQYLNDCLRAYGKTENIQDYFAKLGAVNNEHEQTINLFAQVRNAYTSVQAILTTPYPENANLAQDKETVALIKNLLDSLKRLQRFIKPLLGKGDESDKDERFYGDFTPLWETLNQITPLYNMVRNYMTRKPYSQEKIKLNFENSTLLGGWDLNKEHDNTAIILRKNGLYYLAIMKKSANKIFDKDKLDNSGDCYEKMVYKLLPGANKMLPKVFFSKSRIDEFKPSENIIENYKKGTHKKGANFNLADCHNLIDFFKSSISKHEDWSKFNFHFSDTSSYEDLSDFYREVEQQGYSISFCDVSVEYINKMVEKGDLYLFQIYNKDFSEFSKGTPNMHTLYWNSLFSKENLNNIIYKLNGQAEIFFRKKSLNYKRPTHPAHQAIKNKNKCNEKKESIFDYDLVKDKRYTVDKFQFHVPITMNFKSTGNTNINQQVIDYLRTEDDTHIIGIDRGERHLLYLVVIDSHGKIVEQFTLNEIVNEYGGNIYRTNYHDLLDTREQNREKARESWQTIENIKELKEGYISQVIHKITDLMQKYHAVVVLEDLNMGFMRGRQKVEKQVYQKFEEMLINKLNYLVNKKADQNSAGGLLHAYQLTSKFESFQKLGKQSGFLFYIPAWNTSKIDPVTGFVNLFDTRYESIDKAKAFFGKFDSIRYNADKDWFEFAFDYNNFTTKAEGTRTNWTICTYGSRIRTFRNQAKNSQWDNEEIDLTKAYKAFFAKHGINIYDNIKEAIAMETEKSFFEDLLHLLKLTLQMRNSITGTTTDYLISPVHDSKGNFYDSRICDNSLPANADANGAYNIARKGLMLIQQIKDSTSSNRFKFSPITNKDWLIFAQEKPYLND

SEQ ID NO: 139 - protein, 1253 aa, Prevotella albensis
  Cpf1 (1)..(1253)
MNIKNFTGLYPLSKTLRFELKPIGKTKENIEKNGILTKDEQRAKDYLIVKGFIDEYHKQFIKDRLWDFKLPLESEGEKNSLEEYQELYELTKRNDAQEADFTEIKDNLRSSITEQLTKSGSAYDRIFKKEFIREDLVNFLEDEKDKNIVKQFEDFTTYFTGFYENRKNMYSSEEKSTAIAYRLIHQNLPKFMDNMRSFAKIANSSVSEHFSDIYESWKEYLNVNSIEEIFQLDYFSETLTQPHIEVYNYIIGKKVLEDGTEIKGINEYVNLYNQQQKDKSKRLPFLVPLYKQILSDREKLSWIAEEFDSDKKMLSAITESYNHLHNVLMGNENESLRNLLLNIKDYNLEKINITNDLSLTEISQNLFGRYDVFTNGIKNKLRVLTPRKKKETDENFEDRINKIFKTQKSFSIAFLNKLPQPEMEDGKPRNIEDYFITQGAINTKSIQKEDIFAQIENAYEDAQVFLQIKDTDNKLSQNKTAVEKIKTLLDALKELQHFIKPLLGSGEENEKDELFYGSFLAIWDELDTITPLYNKVRNWLTRKPYSTEKIKLNFDNAQLLGGWDVNKEHDCAGILLRKNDSYYLGIINKKTNHIFDTDITPSDGECYDKIDYKLLPGANKMLPKVFFSKSRIKEFEPSEAIINCYKKGTHKKGKNFNLTDCHRLINFFKTSIEKHEDWSKFGFKFSDTETYEDISGFYREVEQQGYRLTSHPVSASYIHSLVKEGKLYLFQIWNKDFSQFSKGTPNLHTLYWKMLFDKRNLSDVVYKLNGQAEVFYRKSSIEHQNRIIHPAQHPITNKNELNKKHTSTFKYDIIKDRRYTVDKFQFHVPITINFKATGQNNINPIVQEVIRQNGITHIIGIDRGERHLLYLSLIDLKGNIIKQMTLNEIINEYKGVTYKTNYHNLLEKREKERTEARHSWSSIESIKELKDGYMSQVIHKITDMMVKYNAIVVLEDLNGGFMRGRQKVEKQVYQKFEKKLIDKLNYLVDKKLDANEVGGVLNAYQLTNKFESFKKIGKQSGFLFYIPAWNTSKIDPITGFVNLFNTRYESIKETKVFWSKFDIIRYNKEKNWFEFVFDYNTFTTKAEGTRTKWTLCTHGTRIQTFRNPEKNAQWDNKEINLTESFKALFEKYKIDITSNLKESIMQETEKKFFQELHNLLHLTLQMRNSVTGTDIDYLISPVADEDGNFYDSRINGKNFPENADANGAYNIARKGLMLIRQIKQADPQKKFKFETITNKDWLKFAQDKPYLKD

SEQ ID NO: 140 - protein, 1264 aa, Prevotella brevis ATCC 19188
  Cpf1 (1)..(1264)
MKQFTNLYQLSKTLRFELKPIGKTLEHINANGFIDNDAHRAESYKKVKKLIDDYHKDYIENVLNNFKLNGEYLQAYFDLYSQDTKDKQFKDIQDKLRKSIASALKGDDRYKTIDKKELIRQDMKTFLKKDTDKALLDEFYEFTTYFTGYHENRKNMYSDEAKSTAIAYRLIHDNLPKFIDNIAVFKKIANTSVADNFSTIYKNFEEYLNVNSIDEIFSLDYYNIVLTQTQIEVYNSIIGGRTLEDDTKIQGINEFVNLYNQQLANKKDRLPKLKPLFKQILSDRVQLSWLQEEFNTGADVLNAVKEYCTSYFDNVEESVKVLLTGISDYDLSKIYITNDLALTDVSQRMFGEWSIIPNAIEQRLRSDNPKKTNEKEEKYSDRISKLKKLPKSYSLGYINECISELNGIDIADYYATLGAINTESKQEPSIPTSIQVHYNALKPILDTDYPREKNLSQDKLTVMQLKDLLDDFKALQHFIKPLLGNGDEAEKDEKFYGELMQLWEVIDSITPLYNKVRNYCTRKPFSTEKIKVNFENAQLLDGWDENKESTNASIILRKNGMYYLGIMKKEYRNILTKPMPSDGDCYDKVVYKFFKDITTMVPKCTTQMKSVKEHFSNSNDDYTLFEKDKFIAPVVITKEIFDLNNVLYNGVKKFQIGYLNNTGDSFGYNHAVEIWKSFCLKFLKAYKSTSIYDFSSIEKNIGCYNDLNSFYGAVNLLLYNLTYRKVSVDYIHQLVDEDKMYLFMIYNKDFSTYSKGTPNMHTLYWKMLFDESNLNDVVYKLNGQAEVFYRKKSITYQHPTHPANKPIDNKNVNNPKKQSNFEYDLIKDKRYTVDKFMFHVPITLNFKGMGNGDINMQVREYIKTTDDLHFIGIDRGERHLLYICVINGKGEIVEQYSLNEIVNNYKGTEYKTDYHTLLSERDKKRKEERSSWQTIEGIKELKSGYLSQVIHKITQLMIKYNAIVLLEDLNMGFKRGRQKVESSVYQQFEKALIDKLNYLVDKNKDANEIGGLLHAYQLTNDPKLPNKNSKQSGFLFYVPAWNTSKIDPVTGFVNLLDTRYENVAKAQAFFKKFDSIRYNKEYDRFEFKFDYSNFTAKAEDTRTQWTLCTYGTRIETFRNAEKNSNWDSREIDLTTEWKTLFTQHNIPLNANLKEAILLQANKNFYTDILHLMKLTLQMRNSVTGTDIDYMVSPVANECGEFFDSRKVKEGLPVNADANGAYNIARKGLWLAQQIKNANDLSDVKLAITNKEWLQFAQKKQYLKD

SEQ ID NO: 141 - protein, 1205 aa, Pseudobutyrivibrio ruminis
  Cpf1 (1)..(1205)
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSLLKNHENFPKIGNKEIIKLLQSLYDNDTDYKALDSFSNFYTYFSSYNEVRKNLYSDEEKSSTVAYRLINENLPKFLDNIKAYAIAKKAGVRAEGLSEEDQDCLFIIETFERTLTQDGIDNYNAAIGKLNTAINLFNQQNKKQEGFRKVPQMKCLYKQILSDREEAFIDEFSDDEDLITNIESFAENMNVFLNSEIITDFKIALVESDGSLVYIKNDVSKTSFSNIVFGSWNAIDEKLSDEYDLANSKKKKDEKYYEKRQKELKKNKSYDLETIIGLFDDNSDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFNRATLLNGWDKNKETDNLGILFEKDGMYYLGIMNTKANKIFVNIPKATSNDVYHKVNYKLLPGPNKMLPKVFFAQSNLDYYKPSEELLAKYKAGTHKKGDNFSLEDCHALIDFFKASIEKHPDWSSFGFEFSETCTYEDLSGFYREVEKQGYKITYTDVDADYITSLVERDELYLFQIYNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQDKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKFRNTEKNNSFDDKTIVLSEEFKELFSIYGISYEDGAELKNKIMSVDEADFFRSLTRLFQQTMQMRNSSNDVTRDYIISPIMNDRGEFFNSEACDASKPKDADANGAFNIARKGLWVLEQIRNTPSGDKLNLAMSNAEWLEYAQRNQI

SEQ ID NO: 142 - protein, 1154 aa, Proteocatella sphenisci
  Cpf1 (1)..(1154)
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 143 - protein, 1235 aa, Anaerovibrio sp. RM50
  Cpf1 (1)..(1235)
MVAFIDEFVGQYPVSKTLRFEARPVPETKKWLESDQCSVLFNDQKRNEYYGVLKELLDDYYRAYIEDALTSFTLDKALLENAYDLYCNRDTNAFSSCCEKLRKDLVKAFGNLKDYLLGSDQLKDLVKLKAKVDAPAGKGKKKIEVDSRLINWLNNNAKYSAEDREKYIKAIESFEGFVTYLTNYKQARENMFSSEDKSTAIAFRVIDQNMVTYFGNIRIYEKIKAKYPELYSALKGFEKFFSPTAYSEILSQSKIDEYNYQCIGRPIDDADFKGVNSLINEYRQKNGIKARELPVMSMLYKQILSDRDNSFMSEVINRNEEAIECAKNGYKVSYALFNELLQLYKKIFTEDNYGNIYVKTQPLTELSQALFGDWSILRNALDNGKYDKDIINLAELEKYFSEYCKVLDADDAAKIQDKFNLKDYFIQKNALDATLPDLDKITQYKPHLDAMLQAIRKYKLFSMYNGRKKMDVPENGIDFSNEFNAIYDKLSEFSILYDRIRNFATKKPYSDEKMKLSFNMPTMLAGWDYNNETANGCFLFIKDGKYFLGVADSKSKNIFDFKKNPHLLDKYSSKDIYYKVKYKQVSGSAKMLPKVVFAGSNEKIFGHLISKRILEIREKKLYTAAAGDRKAVAEWIDFMKSAIAIHPEWNEYFKFKFKNTAEYDNANKFYEDIDKQTYSLEKVEIPTEYIDEMVSQHKLYLFQLYTKDFSDKKKKKGTDNLHTMYWHGVFSDENLKAVTEGTQPIIKLNGEAEMFMRNPSIEFQVTHEHNKPIANKNPLNTKKESVFNYDLIKDKRYTERKFYFHCPITLNFRADKPIKYNEKINRFVENNPDVCIIGIDRGERHLLYYTVINQTGDILEQGSLNKISGSYTNDKGEKVNKETDYHDLLDRKEKGKHVAQQAWETIENIKELKAGYLSQVVYKLTQLMLQYNAVIVLENLNVGFKRGRTKVEKQVYQKFEKAMIDKLNYLVFKDRGYEMNGSYAKGLQLTDKFESFDKIGKQTGCIYYVIPSYTSHIDPKTGFVNLLNAKLRYENITKAQDTIRKFDSISYNAKADYFEFAFDYRSFGVDMARNEWVVCTCGDLRWEYSAKTRETKAYSVTDRLKELFKAHGIDYVGGENLVSHITEVADKHFLSTLLFYLRLVLKMRYTVSGTENENDFILSPVEYAPGKFFDSREATSTEPMNADANGAYHIALKGLMTIRGIEDGKLHNYGKGGENAAWFKFMQNQEYKNNG

SEQ ID NO: 144 - protein, 1334 aa, Succinivibrio dextrinosolvens H5
  Cpf1 (1)..(1334)
MSSLTKFTNKYSKQLTIKNELIPVGKTLENIKENGLIDGDEQLNENYQKAKIIVDDFLRDFINKALNNTQIGNWRELADALNKEDEDNIEKLQDKIRGIIVSKFETFDLFSSYSIKKDEKIIDDDNDVEEEELDLGKKTSSFKYIFKKNLFKLVLPSYLKTTNQDKLKIISSFDNFSTYFRGFFENRKNIFTKKPISTSIAYRIVHDNFPKFLDNIRCFNVWQTECPQLIVKADNYLKSKNVIAKDKSLANYFTVGAYDYFLSQNGIDFYNNIIGGLPAFAGHEKIQGLNEFINQECQKDSELKSKLKNRHAFKMAVLFKQILSDREKSFVIDEFESDAQVIDAVKNFYAEQCKDNNVIFNLLNLIKNIAFLSDDELDGIFIEGKYLSSVSQKLYSDWSKLRNDIEDSANSKQGNKELAKKIKTNKGDVEKAISKYEFSLSELNSIVHDNTKFSDLLSCTLHKVASEKLVKVNEGDWPKHLKNNEEKQKIKEPLDALLEIYNTLLIFNCKSFNKNGNFYVDYDRCINELSSVVYLYNKTRNYCTKKPYNTDKFKLNFNSPQLGEGFSKSKENDCLTLLFKKDDNYYVGIIRKGAKINFDDTQAIADNTDNCIFKMNYFLLKDAKKFIPKCSIQLKEVKAHFKKSEDDYILSDKEKFASPLVIKKSTFLLATAHVKGKKGNIKKFQKEYSKENPTEYRNSLNEWIAFCKEFLKTYKAATIFDITTLKKAEEYADIVEFYKDVDNLCYKLEFCPIKTSFIENLIDNGDLYLFRINNKDFSSKSTGTKNLHTLYLQAIFDERNLNNPTIMLNGGAELFYRKESIEQKNRITHKAGSILVNKVCKDGTSLDDKIRNEIYQYENKFIDTLSDEAKKVLPNVIKKEATHDITKDKRFTSDKFFFHCPLTINYKEGDTKQFNNEVLSFLRGNPDINIIGIDRGERNLIYVTVINQKGEILDSVSFNTVTNKSSKIEQTVDYEEKLAVREKERIEAKRSWDSISKIATLKEGYLSAIVHEICLLMIKHNAIVVLENLNAGFKRIRGGLSEKSVYQKFEKMLINKLNYFVSKKESDWNKPSGLLNGLQLSDQFESFEKLGIQSGFIFYVPAAYTSKIDPTTGFANVLNLSKVRNVDAIKSFFSNFNEISYSKKEALFKFSFDLDSLSKKGFSSFVKFSKSKWNVYTFGERIIKPKNKQGYREDKRINLTFEMKKLLNEYKVSFDLENNLIPNLTSANLKDTFWKELFFIFKTTLQLRNSVTNGKEDVLISPVKNAKGEFFVSGTHNKTLPQDCDANGAYHIALKGLMILERNNLVREEKDTKKIMAISNVDWFEYVQKRRGVL

SEQ ID NO: 145 - protein, 1259 aa, Synergistes jonesii strain 78-1
  Cpf1 (1)..(1259)
MANSLKDFTNIYQLSKTLRFELKPIGKTEEHINRKLIIMHDEKRGEDYKSVTKLIDDYHRKFIHETLDPAHFDWNPLAEALIQSGSKNNKALPAEQKEMREKIISMFTSQAVYKKLFKKELFSELLPEMIKSELVSDLEKQAQLDAVKSFDKFSTYFTGFHENRKNIYSKKDTSTSIAFRIVHQNFPKFLANVRAYTLIKERAPEVIDKAQKELSGILGGKTLDDIFSIESFNNVLTQDKIDYYNQIIGGVSGKAGDKKLRGVNEFSNLYRQQHPEVASLRIKMVPLYKQILSDRTTLSFVPEALKDDEQAINAVDGLRSELERNDIFNRIKRLFGKNNLYSLDKIWIKNSSISAFSNELFKNWSFIEDALKEFKENEFNGARSAGKKAEKWLKSKYFSFADIDAAVKSYSEQVSADISSAPSASYFAKFTNLIETAAENGRKFSYFAAESKAFRGDDGKTEIIKAYLDSLNDILHCLKPFETEDISDIDTEFYSAFAEIYDSVKDVIPVYNAVRNYTTQKPFSTEKFKLNFENPALAKGWDKNKEQNNTAIILMKDGKYYLGVIDKNNKLRADDLADDGSAYGYMKMNYKFIPTPHMELPKVFLPKRAPKRYNPSREILLIKENKTFIKDKNFNRTDCHKLIDFFKDSINKHKDWRTFGFDFSDTDSYEDISDFYMEVQDQGYKLTFTRLSAEKIDKWVEEGRLFLFQIYNKDFADGAQGSPNLHTLYWKAIFSEENLKDVVLKLNGEAELFFRRKSIDKPAVHAKGSMKVNRRDIDGNPIDEGTYVEICGYANGKRDMASLNAGARGLIESGLVRITEVKHELVKDKRYTIDKYFFHVPFTINFKAQGQGNINSDVNLFLRNNKDVNIIGIDRGERNLVYVSLIDRDGHIKLQKDFNIIGGMDYHAKLNQKEKERDTARKSWKTIGTIKELKEGYLSQVVHEIVRLAVDNNAVIVMEDLNIGFKRGRFKVEKQVYQKFEKMLIDKLNYLVFKDAGYDAPCGILKGLQLTEKFESFTKLGKQCGIIFYIPAGYTSKIDPTTGFVNLFNINDVSSKEKQKDFIGKLDSIRFDAKRDMFTFEFDYDKFRTYQTSYRKKWAVWTNGKRIVREKDKDGKFRMNDRLLTEDMKNILNKYALAYKAGEDILPDVISRDKSLASEIFYVFKNTLQMRNSKRDTGEDFIISPVLNAKGRFFDSRKTDAALPIDADANGAYHIALKGSLVLDAIDEKLKEDGRIDYKDMAVSNPKWFEFMQTRKFDF

SEQ ID NO: 146 - protein, 1250 aa, Smithella sp. SCADC
  Cpf1 (1)..(1250)
MQTLFENFTNQYPVSKTLRFELIPQGKTKDFIEQKGLLKKDEDRAEKYKKVKNIIDEYHKDFIEKSLNGLKLDGLEEYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKIYFRSGTSLTDVSRKVFGEWSIINRALDNYYATTYPIKPREKSEKYEERKEKWLKQDFNVSLIQTAIDEYDNETVKGKNSGKVIVDYFAKFCDDKETDLIQKVNEGYIAVKDLLNTPYPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKENLYYLGIMDKRHNRIFRNVPKADKKDSCYEKMVYKLLPGANKMLPKVFFSQSRIQEFTPSAKLLENYENETHKKGDNFNLNHCHQLIDFFKDSINKHEDWKNFDFRFSATSTYADLSGFYHEVEHQGYKISFQSIADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHVPITMNFKAEGIFNMNQRVNQFLKANPDINIIGIDRGERHLLYYTLINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLKQAKDFFEKFDSIRLNSKADYFEFAFDFKNFTGKADGGRTKWTVCTTNEDRYAWNRALNNNRGSQEKYDITAELKSLFDGKVDYKSGKDLKQQIASQELADFFRTLMKYLSVTLSLRHNNGEKGETEQDYILSPVADSMGKFFDSRKAGDDMPKNADANGAYHIALKGLWCLEQISKTDDLKKVKLAISNKEWLEFMQTLKG

SEQ ID NO: 147 - protein, 1232 aa, Sulfuricurvum sp. PC08-66
  Csm1 (1)..(1232)
  RuvCI_active_site (848)..(848)
  RuvCII_active_site (1063)..(1063)
  RuvCIII_active_site (1213)..(1213)
MLHAFTNQYQLSKTLRFGATLKEDEKKCKSHEELKGFVDISYENMKSSATIAESLNENELVKKCERCYSEIVKFHNAWEKIYYRTDQIAVYKDFYRQLSRKARFDAGKQNSQLITLASLCGMYQGAKLSRYITNYWKDNITRQKSFLKDFSQQLHQYTRALEKSDKAHTKPNLINFNKTFMVLANLVNEIVIPLSNGAISFPNISKLEDGEESHLIEFALNDYSQLSELIGELKDAIATNGGYTPFAKVTLNHYTAEQKPHVFKNDIDAKIRELKLIGLVETLKGKSSEQIEEYFSNLDKFSTYNDRNQSVIVRTQCFKYKPIPFLVKHQLAKYISEPNGWDEDAVAKVLDAVGAIRSPAHDYANNQEGFDLNHYPIKVAFDYAWEQLANSLYTTVTFPQEMCEKYLNSIYGCEVSKEPVFKFYADLLYIRKNLAVLEHKNNLPSNQEEFICKINNTFENIVLPYKISQFETYKKDILAWINDGHDHKKYTDAKQQLGFIRGGLKGRIKAEEVSQKDKYGKIKSYYENPYTKLTNEFKQISSTYGKTFAELRDKFKEKNEITKITHFGIIIEDKNRDRYLLASELKHEQINHVSTILNKLDKSSEFITYQVKSLTSKTLIKLIKNHTTKKGAISPYADFHTSKTGFNKNEIEKNWDNYKREQVLVEYVKDCLTDSTMAKNQNWAEFGWNFEKCNSYEDIEHEIDQKSYLLQSDTISKQSIASLVEGGCLLLPIINQDITSKERKDKNQFSKDWNHIFEGSKEFRLHPEFAVSYRTPIEGYPVQKRYGRLQFVCAFNAHIVPQNGEFINLKKQIENFNDEDVQKRNVTEFNKKVNHALSDKEYVVIGIDRGLKQLATLCVLDKRGKILGDFEIYKKEFVRAEKRSESHWEHTQAETRHILDLSNLRVETTIEGKKVLVDQSLTLVKKNRDTPDEEATEENKQKIKLKQLSYIRKLQHKMQTNEQDVLDLINNEPSDEEFKKRIEGLISSFGEGQKYADLPINTMREMISDLQGVIARGNNQTEKNKIIELDAADNLKQGIVANMIGIVNYIFAKYSYKAYISLEDLSRAYGGAKSGYDGRYLPSTSQDEDVDFKEQQNQMLAGLGTYQFFEMQLLKKLQKIQSDNTVLRFVPAFRSADNYRNILRLEETKYKSKPFGVVHFIDPKFTSKKCPVCSKTNVYRDKDDILVCKECGFRSDSQLKERENNIHYIHNGDDNGAYHIALKSVENLIQMK

SEQ ID NO: 148 - protein, 1247 aa, Uncultured bacterium (gcode 4) ACD_3C00058
  Cpf1 (1)..(1247)
MFKGDAFTGLYEVQKTLRFELVPIGLTQSYLENDWVIQKDKEVEENYGKIKAYFDLIHKEFVRQSLENAWLCQLDDFYEKYIELHNSLETRKDKNLAKQFEKVMKSLKKEFVSFFDAKWNEWKQKFSFLKKWWIDVLNEKEVLDLMAEFYPDEKELFDKFDKFFTYFSNFKESRKNFYADDGRAWAIATRAIDENLITFIKNIEDFKKLNSSFREFVNDNFSEEDKQIFEIDFYNNCLLQPWIDKYNKIVWWYSLENWEKVQWLNEKINNFKQNQNKSNSKDLKFPRMKLLYKQILGDKEKKVYIDEIRDDKNLIDLIDNSKRRNQIKIDNANDIINDFINNNAKFELDKIYLTRQSINTISSKYFSSWDYIRWYFWTGELQEFVSFYDLKETFWKIEYETLENIFKDCYVKGINTESQNNIVFETQGIYENFLNIFKFEFNQNISQISLLEWELDKIQNEDIKKNEKQVEVIKNYFDSVMSVYKMTKYFSLEKWKKRVELDTDNNFYNDFNEYLEGFEIWKDYNLVRNYITKKQVNTDKIKLNFDNSQFLTWWDKDKENERLGIILRREWKYYLWILKKWNTLNFGDYLQKEWEIFYEKMNYKQLNNVYRQLPRLLFPLTKKLNELKWDELKKYLSKYIQNFWYNEEIAQIKIEFDIFQESKEKWEKFDIDKLRKLIEYYKKWVLALYSDLYDLEFIKYKNYDDLSIFYSDVEKKMYNLNFTKIDKSLIDGKVKSWELYLFQIYNKDFSESKKEWSTENIHTKYFKLLFNEKNLQNLVVKLSWWADIFFRDKTENLKFKKDKNGQEILDHRRFSQDKIMFHISITLNANCWDKYWFNQYVNEYMNKERDIKIIWIDRWEKHLAYYCVIDKSWKIFNNEIWTLNELNWVNYLEKLEKIESSRKDSRISWWEIENIKELKNGYISQVINKLTELIVKYNAIIVFEDLNIWFKRWRQKIEKQIYQKLELALAKKLNYLTQKDKKDDEILWNLKALQLVPKVNDYQDIWNYKQSWIMFYVRANYTSVTCPNCWLRKNLYISNSATKENQKKSLNSIAIKYNDWKFSFSYEIDDKSWKQKQSLNKKKFIVYSDIERFVYSPLEKLTKVIDVNKKLLELFRDFNLSLDINKQIQEKDLDSVFFKSLTHLFNLILQLRNSDSKDNKDYISCPSCYYHSNNWLQWFEFNWDANWAYNIARKGIILLDRIRKNQEKPDLYVSDIDWDNFVQSNQFPNTIIPIQNIEKQVPLNIKI

SEQ ID NO: 149 - protein, 1233 aa, Lachnospiraceae bacterium MC2017
  Cpf1 (1)..(1233)
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 150 - protein, 1241 aa, Butyrivibrio proteoclasticus B316
  Cpf1 (1)..(1241)
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEKARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 151 - protein, 1477 aa, Peregrinibacteria bacterium GW2011_GWC2_33_13
  Cpf1 (1)..(1477)
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKK

SEQ ID NO: 152 - protein, 1352 aa, Parcubacteria bacterium GW2011_GWC2_44_17
  Cpf1 (1)..(1352)
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 153 - protein, 1250 aa, Smithella sp. SC_K08D17
  Cpf1 (1)..(1250)
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 154 - protein, 1282 aa, Eubacterium eligens
  Cpf1 (1)..(1282)
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 155 - protein, 1263 aa, Leptospira inadai serovar
  Cpf1 (1)..(1263)
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 156 - protein, 1246 aa, Porphyromonas macacae
  Cpf1 (1)..(1246)
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 157 - protein, 1285 aa, Microgenomates (Roizmanbacteria) bacterium GW2011_GWA2_37_7
  Cpf1 (1)..(1285)
MKSFDSFTNLYSLSKTLKFEMRPVGNTQKMLDNAGVFEKDKLIQKKYGKTKPYFDRLHREFIEEALTGVELIGLDENFRTLVDWQKDKKNNVAMKAYENSLQRLRTEIGKIFNLKAEDWVKNKYPILGLKNKNTDILFEEAVFGILKARYGEEKDTFIEVEEIDKTGKSKINQISIFDSWKGFTGYFKKFFETRKNFYKNDGTSTAIATRIIDQNLKRFIDNLSIVESVRQKVDLAETEKSFSISLSQFFSIDFYNKCLLQDGIDYYNKIIGGETLKNGEKLIGLNELINQYRQNNKDQKIPFFKLLDKQILSEKILFLDEIKNDTELIEALSQFAKTAEEKTKIVKKLFADFVENNSKYDLAQIYISQEAFNTISNKWTSETETFAKYLFEAMKSGKLAKYEKKDNSYKFPDFIALSQMKSALLSISLEGHFWKEKYYKISKFQEKTNWEQFLAIFLYEFNSLFSDKINTKDGETKQVGYYLFAKDLHNLILSEQIDIPKDSKVTIKDFADSVLTIYQMAKYFAVEKKRAWLAEYELDSFYTQPDTGYLQFYDNAYEDIVQVYNKLRNYLTKKPYSEEKWKLNFENSTLANGWDKNKESDNSAVILQKGGKYYLGLITKGHNKIFDDRFQEKFIVGIEGGKYEKIVYKFFPDQAKMFPKVCFSAKGLEFFRPSEEILRIYNNAEFKKGETYSIDSMQKLIDFYKDCLTKYEGWACYTFRHLKPTEEYQNNIGEFFRDVAEDGYRIDFQGISDQYIHEKNEKGELHLFEIHNKDWNLDKARDGKSKTTQKNLHTLYFESLFSNDNVVQNFPIKLNGQAEIFYRPKTEKDKLESKKDKKGNKVIDHKRYSENKIFFHVPLTLNRTKNDSYRFNAQINNFLANNKDINIIGVDRGEKHLVYYSVITQASDILESGSLNELNGVNYAEKLGKKAENREQARRDWQDVQGIKDLKKGYISQVVRKLADLAIKHNAIIILEDLNMRFKQVRGGIEKSIYQQLEKALIDKLSFLVDKGEKNPEQAGHLLKAYQLSAPFETFQKMGKQTGIIFYTQASYTSKSDPVTGWRPHLYLKYFSAKKAKDDIAKFTKIEFVNDRFELTYDIKDFQQAKEYPNKTVWKVCSNVERFRWDKNLNQNKGGYTHYTNITENIQELFTKYGIDITKDLLTQISTIDEKQNTSFFRDFIFYFNLICQIRNTDDSEIAKKNGKDDFILSPVEPFFDSRKDNGNKLPENGDDNGAYNIARKGIVILNKISQYSEKNENCEKMKWGDLYVSNIDWDNFVTQANARH

SEQ ID NO: 158 - protein, 1305 aa, Eubacterium sp.
  Cpf1 (1)..(1305)
MNKAADNYTGGNYDEFIALSKVQKTLRNELKPTPFTAEHIKQRGIISEDEYRAQQSLELKKIADEYYRNYITHKLNDINNLDFYNLFDAIEEKYKKNDKDNRDKLDLVEKSKRGEIAKMLSADDNFKSMFEAKLITKLLPDYVERNYTGEDKEKALETLALFKGFTTYFKGYFKTRKNMFSGEGGASSICHRIVNVNASIFYDNLKTFMRIQEKAGDEIALIEEELTEKLDGWRLEHIFSRDYYNEVLAQKGIDYYNQICGDINKHMNLYCQQNKFKANIFKMMKIQKQIMGISEKAFEIPPMYQNDEEVYASFNEFISRLEEVKLTDRLINILQNINIYNTAKIYINARYYTNVSSYVYGGWGVIDSAIERYLYNTIAGKGQSKVKKIENAKKDNKFMSVKELDSIVAEYEPDYFNAPYIDDDDNAVKAFGGQGVLGYFNKMSELLADVSLYTIDYNSDDSLIENKESALRIKKQLDDIMSLYHWLQTFIIDEVVEKDNAFYAELEDICCELENVVTLYDRIRNYVTKKPYSTQKFKLNFASPTLAAGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFKETNQYNDIGQFYKDVEKQGYSISWAYISEEDINKLDEEGKIYLFEIYNKDLSAHSTGRDNLHTMYLKNIFSEDNLKNICIELNGEAELFYRKSSMKSNITHKKDTILVNKTYINETGVRVSLSDEDYMKVYNYYNNNYVIDTENDKNLIDIIEKIGHRKSKIDIVKDKRYTEDKYFLYLPITINYGIEDENVNSKIIEYIAKQDNMNVIGIDRGERNLIYISVIDNKGNIIEQKSFNLVNNYDYKNKLKNMEKTRDNARKNWQEIGKIKDVKSGYLSGVISKIARMVIDYNAIIVMEDLNKGFKRGRFKVERQVYQKFENMLISKLNYLVFKERKADENGGILRGYQLTYIPKSIKNVGKQCGCIFYVPAAYTSKIDPATGFINIFDFKKYSGSGINAKVKDKKEFLMSMNSIRYINECSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKFKENELYINVTEWLDYIQNRRFE

SEQ ID NO: 159 - protein, 1084 aa, Smithella sp. SC_K08D17
  Csm1 (1)..(1084)
  RuvCI_active_site (701)..(701)
  RuvCII_active_site (926)..(926)
  RuvCIII_active_site (1066)..(1066)
MEKYKITKTIRFKLLPDKIQDISRQVAVLQNSTNAEKKNNLLRLIQRGQELPKLLNEYIRYSDNHKLKSNVTVHFRWLRLFTKDLFYNWKKDNTEKKIKISDVDYLSRVFEDFFNEWETVIERINTDCNRPEESKTRDAEIAFSIKKIATKQMFPFIKSFVYNSNYKNSEETKSKLTALLNEFETVLKICEQNYLPSQSAGIVIAKASFNYYTINKKQKDYKGYTDDIEKIEKGMNSKFHYERKYDQLLEELNLIALKELPLIEFYSKIKSYKSTRKIEFSEAVSKGLAFADLKSKFPLFQTESNKYAEFLELTGRITQISTAKSLLSKDNPEAQKLRDEIKKLRINRGEYFKNNFHKYISLCNLYKKIADKKGRLKGQVKGIENERIDSQRIQHWALVLEDNLKHSLILIPKEKVTEVYRKVRASKADSTSSSSSLYYFESMTYRALHKLCFGVNGNTFLPEIQKELPEYNPNKQSDFGEFCFHKSNTDKEIDEPKLISFYQSVLKTNYVKDNLNLPQSVFDEATVQTFETRQDFQIALEKCCYAKKTIISETLKKEILEDNNVQIFQITSLDLQRSEQKNLKAHTKIWNRFWTKQNETANYDLRLNPETAIVWRKPKKTRIDKYGAGTSLYDPKKRNRYLHEQYTLCTTVTDNALNNEITFAFEDTKKKGTEIVKYNEKINQTLKKEFNKNQLWFYGIDAGEIELATLALMNKDKEPQLFTVYELKKSDFFKHGYIYNKERELVIREKPYKAIQNLSYFLNEELYEKTFRDGKFQETFNELFKEKHVSAIDLTTAKVINGKIILNGDMITFLNLRILHAKRKIYEELIINPQAELKENEKEYYLYFDKEGTEKVEKIYRSRLDFEHIKPYQEIRNDLNAYFKNVQKNEAKVEDQINQTRRALVGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPSCEKKAYELQKEKKGEEKPAENKRYEADKKAGVFCCPKCGFHNRTNPMGYESLDSNDKVAAFNIAKRGFEQNFRQ

SEQ ID NO: 160 - protein, 1064 aa, Smithella sp. SCADC
  Csm1 (1)..(1064)
  RuvCI_active_site (701)..(701)
  RuvCII_active_site (922)..(922)
  RuvCIII_active_site (1045)..(1045)
MEKYKITKTIRFKLLPDKIQDISRQVAVLQNSTNAEKKNNLLRLVQRGQELPKLLNEYIRYSDNHKLKSNVTVHFRWLRLFTKDLFYNWKKDNTEKKIKISDVVYLSHVFEAFLKEWESTIERVNADCNKPEESKTRDAEIALSIRKLGIKHQLPFIKGFVDNSNDKNSEDTKSKLTALLSEFEAVLKICEQNYLPSQSSGIAIAKASFNYYTINKKQKDFEAEIVALKKQLHARYGNKKYDQLLRELNLIPLKELPLKELPLIEFYSEIKKRKSTKKSEFLEAVSNGLVFDDLKSKFPLFQTESNKYDEYLKLSNKITQKSTAKSLLSKDSPEAQKLQTEITKLKKNRGEYFKKAFGKYVQLCELYKEIAGKRGKLKGQIKGIENERIDSQRLQYWALVLEDNLKHSLILIPKEKTNELYRKVWGAKDDGASSSSSSTLYYFESMTYRALRKLCFGINGNTFLPEIQKELPQYNQKEFGEFCFHKSNDDKEIDEPKLISFYQSVLKTDFVKNTLALPQSVFNEVAIQSFETRQDFQIALEKCCYAKKQIISESLKKEILENYNTQIFKITSLDLQRSEQKNLKGHTRIWNRFWTKQNEEINYNLRLNPEIAIVWRKAKKTRIEKYGERSVLYEPEKRNRYLHEQYTLCTTVTDNALNNEITFAFEDTKKKGTEIVKYNEKINQTLKKEFNKNQLWFYGIDAGEIELATLALMNKDKEPQLFTVYELKKLDFFKHGYIYNKERELVIREKPYKAIQNLSYFLNEELYEKTFRDGKFNETYNELFKEKHVSAIDLTTAKVINGKIILNGDMITFLNLRILHAQRKIYEELIENPHAELKEKDYKLYFEIEGKDKDIYISRLDFEYIKPYQEISNYLFAYFASQQINEAREEEQINQTKRALAGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPKCLRRFKDYDKNKQEGFCKCQCGFDTRNDLKGFEGLNDPDKVAAFNIAKRGFEDLQKYK

SEQ ID NO: 161 - protein, 1403 aa, Parcubacteria bacterium GW2011_GWA2_41_14
  Cpf1 (1)..(1403)
MLFFMSTDITNKPREKGVFDNFTNLYEFSKTLTFGLIPLKWDDNKKMIVEDEDFSVLRKYGVIEEDKRIAESIKIAKFYLNILHRELIGKVLGSLKFEKKNLENYDRLLGEIEKNNKNENISEDKKKEIRKNFKKELSIAQDILLKKVGEVFESNGSGILSSKNCLDELTKRFTRQEVDKLRRENKDIGVEYPDVAYREKDGKEETKSFFAMDVGYLDDFHKNRKQLYSVKGKKNSLGRRILDNFEIFCKNKKLYEKYKNLDIDFSEIERNFNLTLEKVFDFDNYNERLTQEGLDEYAKILGGESNKQERTANIHGLNQIINLYIQKKQSEQKAEQKETGKKKIKFNKKDYPTFTCLQKQILSQVFRKEIIIESDRDLIRELKFFVEESKEKVDKARGIIEFLLNHEENDIDLAMVYLPKSKINSFVYKVFKEPQDFLSVFQDGASNLDFVSFDKIKTHLENNKLTYKIFFKTLIKENHDFESFLILLQQEIDLLIDGGETVTLGGKKESITSLDEKKNRLKEKLGWFEGKVRENEKMKDEEEGEFCSTVLAYSQAVLNITKRAEIFWLNEKQDAKVGEDNKDMIFYKKFDEFADDGFAPFFYFDKFGNYLKRRSRNTTKEIKLHFGNDDLLEGWDMNKEPEYWSFILRDRNQYYLGIGKKDGEIFHKKLGNSVEAVKEAYELENEADFYEKIDYKQLNIDRFEGIAFPKKTKTEEAFRQVCKKRADEFLGGDTYEFKILLAIKKEYDDFKARRQKEKDWDSKFSKEKMSKLIEYYITCLGKRDDWKRFNLNFRQPKEYEDRSDFVRHIQRQAYWIDPRKVSKDYVDKKVAEGEMFLFKVHNKDFYDFERKSEDKKNHTANLFTQYLLELFSCENIKNIKSKDLIESIFELDGKAEIRFRPKTDDVKLKIYQKKGKDVTYADKRDGNKEKEVIQHRRFAKDALTLHLKIRLNFGKHVNLFDFNKLVNTELFAKVPVKILGMDRGENNLIYYCFLDEHGEIENGKCGSLNRVGEQIITLEDDKKVKEPVDYFQLLVDREGQRDWEQKNWQKMTRIKDLKKAYLGNVVSWISKEMLSGIKEGVVTIGVLEDLNSNFKRTRFFRERQVYQGFEKALVNKLGYLVDKKYDNYRNVYQFAPIVDSVEEMEKNKQIGTLVYVPASYTSKICPHPKCGWRERLYMKNSASKEKIVGLLKSDGIKISYDQKNDRFYFEYQWEQEHKSDGKKKKYSGVDKVFSNVSRMRWDVEQKKSIDFVDGTDGSITNKLKSLLKGKGIELDNINQQIVNQQKELGVEFFQSIIFYFNLIMQIRNYDKEKSGSEADYIQCPSCLFDSRKPEMNGKLSAITNGDANGAYNIARKGFMQLCRIRENPQEPMKLITNREWDEAVREWDIYSAAQKIPVLSEEN

SEQ ID NO: 162 - protein, 1300 aa, Francisella tularensis subsp. novicida F6168
  Cpf1 (1)..(1300)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 163 - protein, 1307 aa, Francisella novicida
  Cpf1 (1)..(1307)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISKYINDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILSNFAAIPMIFDEIAQNKDNLAQISIKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLASGWDKNKESANTAILFIKDDKYYLGIMDKKHNKIFSDKAIEENKGEGYKKIVYKQIADASKDIQNLMIIDGKTVCKKGRKDRNGVNRQLLSLKRKHLPENIYRIKETKSYLKNEARFSRKDLYDFIDYYKDRLDYYDFEFELKPSNEYSDFNDFTNHIGSQGYKLTFENISQDYINSLVNEGKLYLFQIYSKDFSAYSKGRPNLHTLYWKALFDERNLQDVVYKLNGEAELFYRKQSIPKKITHPAKETIANKNKDNPKKESVFEYDLIKDKRFTEDKFFFHCPITINFKSSGANKFNDEINLLLKEKANDVHILSIDRGERHLAYYTLVDGKGNIIKQDNFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 164 - protein, 1300 aa, Francisella cf. novicida Fx1
  Cpf1 (1)..(1300)
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKKSIPKKITHPAKEAIANKNKDNPKKESFFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSILNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 165 - protein, 1264 aa, Moraxella lacunata
  Cpf1 (1)..(1264)
MLFQEFTHLYPLSKTVRFELKPIGKTLEHIHAKDFLSQDETMADMYQKVKAILDDYHRDFIADMMSGVVLTKLAEFYEVYLALRKTPKDDSLQKQLTEIQTALRKEIVKPIGSGGKYKAGYDRLFGAKLFKDGKELGDLAKFVITQEGESSPKLAHIAHFEKFSTYFTGFHDNRKNMYSDEDKHTAIAYRLIHENLPRFIDNLQILATIKQKHSALYDQIVNELNANGLDVSLASHLDGYHKLLTQEGITAYNTLLGGISGEAGSRKIQGINELINIHHNQHCQKSERIAKLRPLHKQILSDGMGVSFLPSKFADDSEVCQAVNEFYRHYAHVFAKVQSLFDRFDDYRKDGIYVEHKNLNELSKQAFGDFALLGRVLDGYYVDVVNPEFNERFAKAKTDNAKEKLTKEKDKFIKGVHSLASLEQAIEHYIAGHDDESVQAGKLGQYFKHGLAGVDNPIQKIHNSHSTIKGFLERERPAGERALPKIKSDKSPEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNAGKSVYQKMVYKLLPGPNKMLPKVFFAKSNLDYYNPSAELLDKYAQGTHKKGNNFNLKDCHALIDFFKASINKHPEWQHFGFEFSPTSSYQDLSDFYREVEPQGYQVKFVDINAEYIDELVEQGQLYLFQIYNKDFSPKAHGKPNLHTLYFKALFSENNLANPIYKLNGEAEIFYRKASLDMNETTIHRAGEVLENKNPDNPKKRQFVYDIIKDKRYTQDKFMLHVPITMNFGVQGMTIKEFNKKVNQSIQQYNDVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLALKDKADDEIGSYKNALQLTNNFTDLKSIGKQTGFLFYVPAWNTSKIDPATGFVDLLKPRYENIAQSQAFFGKFDKIFYNADKGYFEFYVDYAKFTDKAKNSRQTWVICSHGDKRYVYDKTANQNKGATIGINVNDELKSLFARYHINDKQPNLVMDICQNNDKEFHKSLMYLLKALLALRYSNASSDEDFILSPVADDKGVFFNSALADDTQPQNADANGAYHIALKGLWLLNELKNSNDLDKIKLAIDNQTWLNFAQNR

SEQ ID NO: 166 - protein, 1207 aa, Pseudobutyrivibrio xylanivorans
  Cpf1 (1)..(1207)
MYYQNLTKMYPISKTLRNELIPVGKTLENIRKNGILEADIQRKADYEHVKKLMDNYHKQLINEALQGVHLSDLSDAYDLYFNLSKEKNSVDAFSKCQDKLRKEIVSFLKNHENFPKIGNKEIIKLIQSLNDNDADNNALDSFSNFYTYFSSYNEVRKNLYSDEEKSSTVAYRLINENLPKSLDNIKAYAIAKKAGVRAEGLSEEEQDCLFIIETFERTLTQDGIDNYNADIGKLNTAINLYNQQNKKQEGFRKVPQMKCLYKQILSDREEAFIDEFSDDEDLITNIESFAENMNVFLNSEIITDFKNALVESDGSLVYIKNDVSKTLFSNIVFGSWNAIDEKLSDEYDLANSKKKKDEKYYEKRQKELKKNKSYDLETIIGLFDDSIDVIGKYIEKLESDITAIAEAKNDFDEIVLRKHDKNKSLRKNTNAVEAIKSYLDTVKDFERDIKLINGSGQEVEKNLVVYAEQENILAEIKNVDSLYNMSRNYLTQKPFSTEKFKLNFENPTLLNGWDRNKEKDYLGILFEKEGMYYLGIINNNHRKIFENEKLCTGKESCFNKIVYKQISNAAKYLSSKQINPQNPPKEIAEILLKRKADSSSLSRKETELFIDYLKDDFLVNYPMIINSDGENFFNFHFKQAKDYGSLQEFFKEVEHQAYSLKTRPIDDSYIYRMIDEGKLYLFQIHNKDFSPYSKGNLNLHTIYLQMLFDQRNLNNVVYKLNGEAEVFYRPASINDEEVIIHKAGEEIKNKNSKRAVDKPTSKFGYDIIKDRRYSKDKFMLHIPVTMNFGVDETRRFNDVVNDALRNDEKVRVIGIDRGERNLLYVVVVDTDGTILEQISLNSIINNEYSIETDYHKLLDEKEGDRDRARKNWTTIENIKELKEGYLSQVVNVIAKLVLKYNAIICLEDLNFGFKRGRQKVEKQVYQKFEKMLIDKLNYLVIDKSRKQEKPEEFGGALNALQLTSKFTSFKDMGKQTGIIYYVPAYLTSKIDPTTGFANLFYVKYENVEKAKEFFSRFDSISYNNESGYFEFAFDYKKFTDRACGARSQWTVCTYGERIIKYRNADKNNSFDDKTIVLSEEFKELFSIYGISYEDGAELKNKIMSVDEADFFRCLTGLLQKTLQMRNSSNDGTRDYIISPIMNDRGEFFNSEACDASKPKDADANGAFNIARKGLWVLEQIRNTPSGDKLNLAMSNAEWLEYAQRNQI

SEQ ID NO: 167 - protein, 973 aa, Sneathia amnii
  Cpf1 (1)..(973)
MTEEDTKSFVDEILLTPESVIKTIDNFIDSIIMNDIEGLKEEFLKISLENFEGIYISNKKLNEISNRKFGDYNSINMMIKQSMNEKGILSKKEINELIPDLENINKPKVKSFNLSFIFENLTKEHKELIIDYIRENICNVIENVKITIEKYRNIDNKIEFKNNAEKVSKIKEMLESINELCKLIKEFNTDEIEKNNEFYNILNKNFEIFESSYKVLNKVRNFVTKKEVIENKMKLNFSNYQLGNGWHKNKEKDCSIILFRKRNNERWIYYLGILKHGTKIKENDYLSSVDTGFYKMDYYAQNSLSKMIPKCSITVKNVKNAPEDESVILNDSKKFNEPLEITPEIRKLYGNNEHIKGDKFKKESLVKWIDFCKEFLLKYKSFEKAKKEILKLKESNLYENLEEFYSDAEEKAYFLEFINIDEDKIKKLVKEKNLYLFQIYNKDFSAYSTGNKNLHTMYFEELFTDENLKKPVFKLNGNTEVFYRIASSKPKIVHNKGEKLVNKTYLDDGIIKTIPDSVYEEISEKVKNNEDYSKLLEENNIKNLEIKVATHEIVKDKRYFENKFLFYLPITLNKKVSNKNTNKNINKNVIDEIKDCNEYNVIGIDRGERNLISLCIINQNGEIILQKEMNIIQSSDKYNVDYNEKLEIKSKERDNAKKNWSEIGKIKDLKSGYLSAVVHEIVKLAIEYNAVIILEDLNNGFKNSRKKVDKQIYQKFERALIEKLQFLIFKNYDKNEKGGLRNAFQLTPELKNITKVASQQGIIIYTNPAYTSKIDPTTGYANIIKKSNNNEESIVKAIDKISYDKEKDMFYFDINLSNSSFNLTVKNVLKKEWRIYTNGERIIYKDRKYITLNITQEMKDILSKCGIDYLNIDNLKQDILKNKLHKKVYYIFELANKMRNENKDVDYIISPVLNKDGKFFMTQEINELTPKDADLNGAYNIALKGKLMIDNLNKKEKFVFLSNEDWLNFIQGR

SEQ ID NO: 168 - protein, 1368 aa, Candidatus Campbellbacteria bacterium
  Cpf1 (1)..(1368)
MKKEKEFKSFGDFTNLYEISKTLRFELKPVENTQTMLDEADVFGKDKVIKDKYTKTKPFIDKLHREFVDESLKDVSLSGLKKYSEVLENWKKNKKDKDIVKELKKEEERLRKEVVEFFDNTAKKWANEKYKELGLKKKDIGILFEESVFDLLKEKYGEEQDSFLKEEKGDFLKNEKGEKVSIFDEWKGFVGYFTKFQETRKNFYKNDGTETALATRIIDQNLKRFCDNIDDFKKIKNKIDFSEVEKNFNKTADVFSLDFYNQCLLQKGIDSYNEFIGGKTLENGKKLKGVNELVNEYRQKNKNEKVSFLKLLDKQILSEKEKLSFGIENDEQLLVVLNSFYETAEEKTKILRTLFGDFVEHNENYDLDKTYISKVAFNTISHKWTNETHKFEELLYGAMKEDKPIGLNYDKKEDSYKFPDFIALGYLKKCLNNLDCDTKFWKEKYYENNADKKDKDKGFLTGGQNAWDQFLQIFIFEFNQLFNSEAFDNKGKEIKIGYDNFRKDFEEIINQKDFKNDENLKIAIKNFADSVLWIYQMAKYFAIEKKRGWDDDFELSEFYTNPSNGYSLFYDRAYEEIVQKYNDLRNYLTKKPYKEDKWKLNFENPTLANGFDKNKESDNSTVILRKKRKYYLGLMKKGNNKIFEDRNKAEFIRNIESGAYEKMAYKYLPDVAKMIPKCSTQLNEAKNHFRNSADDLEIKKSFSNPLKITKRIFDLNNIQYDKTNVSKKISGDNKGIKIFQKEYYKISGDFDVYKSALNDWIDFCKDFLSKYDSTKDFDFSILRKTKDYKSLDEFYVDVAKITYKISFTPVSESYIDQKNKNGELYLFEIYNQDFAKGKMGAKNLHTLYFENVFSPENISKNFPIKLNGNAELFFRPKSIESKKEKRNFVREIVNKKRYSEDKIFFHCPITLNRETGSIYRFNNYVNNFLSENNINIIGVDRGEKHLAYYSVIDKNGVKIGGGSFNEINKVDYAKKLEERAGEREQSRKDWQVVEGIKDLKKGYISQVVRELADLAIKHNAIIVLEDLNMRFKQIRGGIEKSIYQQLEKALIDKLSFLVEKGEKDPNQAGHILKAYQLAAPFTSFKDMGKQTGIVFYTQASYTSKTCPNCGFRKNNNKFYFENNIGKAQDALKKLKTFEYDSENKCFGLSYCLSDFANKEEVEKNKNKKRNNAPYSDIEKKDCFELSTKDAVRYRWHDKNTERGKTFFEGESVYEEKEEKEIGQTKRGLVKEYDISKCLIGLFEKTGLDYKQNLLDKINSGKFDGTFYKNLFNYLNLLFEIRNSISGTEIDYISCPECQFHTDKSKTIKNGDDNGSYNIARKGMIILDKIKQFKKENGSLDKMGWGELFIDLEEWDKFAQKKNNNIIDK

SEQ ID NO: 169 - protein, 1390 aa, Candidatus Wildermuthbacteria bacterium
  Cpf1 (1)..(1390)
MIDNTKEKKEGSVFDGFTRKYQLSKTLRFELRPILNTPKMLDDEQVIKNDETRRKKYEAVKPWFDQLHREFIEDALKSFKFKNLAIYQDTFQTWQKDRKSKQKKDTLVKIEVGLREEIVRRFEEVANIWVRSEQYKLLGIKKEGLGMLFEAGVFRLLKERFKNEKDTTVDGNNIFDEWTRWTGYFKKFFETRKNFYKSDDTSTAIAYRVINQNLRRFCENIQIFEKISEKIEFSEVEKSFDISCAGIFSLAYYNACLLQGGIDTYNKIIGGEVDEKDKKIPGINELINKYRQDNSGEKIPFLKQLDKQIHSAKEAFIESIETNKELVGKLKTFYENAEVKIQSFRNLIADIVTDYSGYDIDKIYLTKEAVSHNASRWFASFESFERDLFAVVAEKQNKLVYELLRTHKNDSKISDKDGKFSFPDFIKCSHIKRALEKQEGRIWKGEYYEDIVDFEKIKDVFTQFLCVFKFELEQQFFRKTTSAQTGEQTKIGYEIFVTKINELITRENPVIDLEEKIAIKNFADATLLIYQIAKYFAVEKRRGWLDNYDLDDRFYKSSDIGYLNFYRDAFEQIVRPYNLFRNYLTKKPYNTNKWVLSFENPTLADGWDKNKEKTNAAVILRKDGRYYLGIIKEDCKSLFADRYSKEMSEGIESGSFQKMAYKFFPEASKMIPKCSTQTKNVKEHFRKSSSDYNLFHEKDYKISVAITKNIYELNNVFYRKDNIEESFVPKNDFEKKLGVKKFQRQYLEISRDNNGYKQALAQWIEFCIRFLKAYKSTTIFDYSRLREAKEYESLDAFYQDINALTYNISFVPISEQYIKEKNDNGELFLFEIYNKDWSLGPMDKNRKRTKNLHTLYFEQLFSKENEQENFLFQLNGEAELFFRPKTEEKRLGYKVWDAGEKKWVKAKEKEDGAVIDRKRYAKDIILFHCPITLNRVSESKTKREMDVEIREVLSSTPGVHIIGVDRGEKHLAYYSVIDQNGKIIETDTLNSIGKDGRGKPVEYASKLEKRAQEREASRRDWEEVEAIKDLKKGYISQVIRNLADLIIKHNAIIVFEDLNMRFKQIRGGIEKSAYQQLERALIDKLSFLVKKGEEDPKQTGHILRAYQLAAPVIAFKDMGKQTGLIFYTQAGYTSKTCPECGYRRNIKCLFENIEQAKTLIENLESINYNKKEDVFQISYSLEKLSSKDQKKEKKVSNELYAKTLKKDIFILTTKNALRYKWYDRYSEKAKVAKRGIDEYKGEVNESETKKGVVKEFNLTEYLKGLLKTYEIDYEHGGIREQILSVARGREFYKDFLYALFLLTETRHSISGRNTDYIQCPECEFDSRKGFKDIKEFNGDANGAYNIARKGIMILEKIKQFKKDNDGNLEKMGWGDLSISIEEWDKFTQKE

SEQ ID NO: 170 - protein, 1390 aa, Candidatus Wildermuthbacteria bacterium; identical to SEQ ID NO: 169
  Cpf1 (1)..(1390)

SEQ ID NO: 171 - protein, 1323 aa, Treponema porcinum
  Cpf1 (1)..(1323)
MKISEEFCGQGNGYSISKTLRFELKPKGKTLENIEKEKLLESDFKKSQDYKDVKIILDNYHKYFIDDVLQKVNLDWTKLAASITDYNKNKEDDSSVIKEQDFLRKEIVKIISKDKRFACLTASTPKDLFNSILLEWFEKSTEFSLNKKAVETFKRFSSYFKGFQENRKNMYKDEPIPTAVPYRIVNENFPKFLQNAESFKEIQKKCPEVIELVEKELSAYLGNDKLSDIFCVKNFNRYLCQTGAENQRGIDYYNQIIGGIVQKENDVKLRGINEFLNLFWQQHVDFAKDNRRIKFVPLYKQILSDRSSLSFKIQTLESDEELKEAVLSFAKKLDSKNKDGKNIFDLVMELTENINQYDLSQIYINQKDMNAVSKTLTGDWAYLQKRMNIFAEETLTKSEQKRWKKELDDDTSKSKGIFSFEELNKVLEYSSENCSAVSIKIQEYFETTKRWYFEKQTGIFTKGEEIIEPSISGLCGQIKSNFDEVNKVFGNVSSENTLRENPEEVEKIKNYLDSVQNLLHRIKPLKVNGIGDTSFYSEYDEIYSVLYEVISLYNKTRNYISKKSGIPEKFKLNFDNPTLADGWDQNKEQANTSVILIKDDEYFLGIMNANNKPKFLENYEGNTEKCYQKMIYKLLPGPNKMLPKVFFSTKGIETFNPPKEILNGYNAGKHKKGDSFDLDFCHSLIDWFKDAINRHEDWKKFDFKFSETSSYKDISEFYREISEQGYKLTFTAIPESVVEKMVTDGNLFLFQIYNKDFAKGASGKPNMHTLYWKQLFSKENLSDTILKLNGEAEIFYREPGIKEPIVHKTGSKLVNKVTKDGVSVPAEIYNEIYKVQNGMQTELSETAQVFVKEHEVSVKTASHDITKDKHFTEAKFLFHVPITINFKAQGNSLTMNERVRKFLKNNPEVNIIGLDRGERHLIYFSLINQKGEILKQFTFNEVERKQNDRIIKVDYHEKLDNREKERDAARKNWTAIGKIAELKEGYLSAVIHELTKMMIQYNAVIVMEDLNFGFKRGRFHVEKQVYQKFERMLIDKLNYLVFKDKGFTEPGGVLNGYQLAGQFESFQKLGKQSGFLFYVPAGYTSKIDPKSGFADLFNLRDLTNVRRKREFFSKFDSIKYDSETMSFSFAFDYKNFDGKGKTEMAKTKWTVFSKDKRIVYFPKNKSYSDVFPTDELKQTFEQAEIKIHDDENLLDVIMEIGADLKPDEKPNQNVASFWDSLLRNFKLILQMRNSNAQTGEDYIISPVKADDGTFFDSRNQLSLGKEAKLPIDADANGAYHIALKGLELLRRFNETDEIKLKKADMKISNADWFKFVQEKQYLN

SEQ ID NO: 172 - protein, 1276 aa, Sphingobacteriales bacterium
  Cpf1 (1)..(1276)
MQQFINKYTLSKTLRFELKPIGKTLENIQTKGLLQQDAIRAKSYQEVKKLIDRYHQYFIELALDGLKLNNLQDFQEQYLASPEEKKKEDFKKKFEKNQDDLRKEIVAAFKTGDANEIFKVLDKKELITELMVAWLTKQEDKDRIEEFKTFTTYFIGFHENRKNMYTDKAQSTAIAYRLVHENLPKFLDNIKVFEKLKAVPELHEKCSVLYKEIEEYLNIRSIDEAFELDYYNSVLTQKQIEVYNLIIGGRVAKENEKKIQGLNEYINLYNQPKDKKNKIPKLKPLYKMILSDRESVSFLAEKFENSQEVLKAIQEYYHANIKSYQSSEKDGAENVLERLQELLANLSSNNLSQIYIRNGKTITDISQALFGDFSLIKDALKYSFTNTLEIGRNGLSKKQEEVIEKYLKQDYFSITEIEVALWNYRTENDLLKDLEEEQHLIANYFNSYFKTTVNDKEYDLVANVTAKYSCIKGLLEQDYPEDKKLNQETKEIDDIKAFLDALMLVLHFVKPLMLPHDSTLEKDQSFYNTIAPYYEELQYLISLYNKVRNFASQKAYSVEKYKLNFENSTLLAGWDVNKEPDNTSVLFRKENDYFLGVMDKKHNGIFKKTPKSKTQDTYSKVNYKLLPGASKMLPKVFFSRSNIAFYNPSEEIITIRNHSTHTKGGTPQTGFEKKDFNLSDCRKMIDFFKDSIAKHPDWKQFGFNFSDTDSYDSIDGFYREKEAQGYTISYTEIDETYIHQLVDEGKLYLFQIYNKDFSEFSKGKPNMHTLYWKALFDSENLRDVVYKLNGQAEIFYRKSSIKKDKIIVHKANEKVANKNPLNTKKESLFTYDLVKDKRFTVDKFQFHVPITLNFKASGNDYINQEVLSFLRQNPDVNIIGLDRGERHLIYLSLINQKGEILQQFSLNDIINEYKGITHKTAYKTLLEKKEKERADARENWGTIESIKELKEGYISQVVHKIAKMMVEYNAIVVMEDLNMGFKRGRFAVEKQVYQKLEKMLIDKLNYLVFKDKAPNEAGGLYNALQLANKFESFQKMGKQSGFLFYVPAWNTSKIDPTTGFVNLFYTKYESIEKAQKFFEKFDSIHFNTKEQYFEFAFDYDNFTERATGTQTQWTVCTQGERILTFRNPSANNQWDNKEIKLTEQFEDLLGKHNISYGSGTCIKAQVATQSGKDFLKGMMDLFKLTLQMRNSITNSEVDYLISPVRNAQGSFYDSRNADATLPKDADANGAYHIAKKGLMWLHQIHEFEGNDWRKLDLDKTNKGWLNFVQPKNKTNE

SEQ ID NO: 173 - protein, 1261 aa, Eubacterium coprostanoligenes
  Cpf1 (1)..(1261)
MDFFKNDMYFLCINGIIVISKLFAYLFLMYKRGVVMIKDNFVNVYSLSKTIRMALIPWGKTEDNFYKKFLLEEDEERAKNYIKVKGYMDEYHKNFIESALNSVVLNGVDEYCELYFKQNKSDSEVKKIESLEASMRKQISKAMKEYTVDGVKIYPLLSKKEFIRELLPEFLTQDEEIETLEQFNDFSTYFQGFWENRKNIYTDEEKSTGVPYRCINDNLPKFLDNVKSFEKVILALPQKAVDELNANFNGVYNVDVQDVFSVDYFNFVLSQSGIEKYNNIIGGYSNSDASKVQGLNEKINLYNQQIAKSDKSKKLPLLKPLYKQILSDRSSLSFIPEKFKDDNEVLNSINVLYDNIAESLEKANDLMSDIANYNTDNIFISSGVAVTDISKKVFGDWSLIRNNWNDEYESTHKKGKNEEKFYEKEDKEFKKIKSFSVSELQRLANSDLSIVDYLVDESASLYADIKTAYNNAKDLLSNEYSHSKRLSKNDDAIELIKSFLDSIKNYEAFLKPLCGTGKEESKDNAFYGAFLECFEEIRQVDAVYNKVRNHITQKPYSNDKIKLNFQNPQFLAGWDKNKERAYRSVLLRNGEKYYLAIMEKGKSKLFEDFPEDESSPFEKIDYKLLPEPSKMLPKVFFATSNKDLFNPSDEILNIRATGSFKKGDSFNLDDCHKFIDFYKASIENHPDWSKFDFDFSETNDYEDISKFFKEVSDQGYSIGYRKISESYLEEMVDNGSLYMFQLYNKDFSENRKSKGTPNLHTLYFKMLFDERNLEDVVYKLSGGAEMFYRKPSIDKNEMIVHPKNQPIDNKNPNNVKKTSTFEYDIVKDMRYTKPQFQLHLPIVLNFKANSKGYINDDVRNVLKNSEDTYVIGIDRGERNLVYACVVDGNGKLVEQVPLNVIEADNGYKTDYHKLLNDREEKRNEARKSWKTIGNIKELKEGYISQVVHKICQLVVKYDAVIAMEDLNSGFVNSRKKVEKQVYQKFERMLTQKLNYLVDKKLDPNEMGGLLNAYQLTNEATKVRNGRQDGIIFYIPAWLTSKIDPTTGFVNLLKPKYNSVSASKEFFSKFDEIRYNEKENYFEFSFNYDNFPKCNADFKREWTVCTYGDRIRTFRDPENNNKFNSEVVVLNDEFKNLFVEFDIDYTDNLKEQILAMDEKSFYKKLMGLLSLTLQMRNSISKNVDVDYLISPVKNSNGEFYDSRNYDITSSLPCDADSNGAYNIARKGLWAINQIKQADDETKANISIKNSEWLQYAQNCDEV

SEQ ID NO: 174 - DNA, 3675 bp, Lachnospiraceae bacterium MC2017
  Cpf1 (1)..(3675)
atgggtctctacgatggcttcgtcaatagatatagcgtctccaagacactgagattcgagctcatcccgcaaggacggacaagggagtacatagaaactaacgggatactctccgacgatgaagagagggcaaaggactacaagactattaagcgcttgatagatgagtatcacaaggattatatatcgaggtgtctgaaaaatgttaatataagctgcctggaagagtattaccacctctataatagctcgaacagggacaaacgccacgaggagctggacgctttgagcgaccaaatgcggggagagatagcgtcttttttgacaggaaatgacgagtacaaggagcaaaagtcaagggacataataataaatgagcggataattaatttcgcgagcaccgatgaggaactggcagccgtgaagaggttccggaaattcacctcttatttcaccggcttctttacaaacagggagaacatgtattccgcagaaaagaaatccaccgcaatcgcccaccgcatcattgatgtcaacctgcctaagtatgtggataacattaaggccttcaatactgccattgaggctggcgtgttcgacattgccgagttcgagagcaacttcaaggcgataacggacgaacacgaggtgtctgatcttctggatataaccaagtattcaaggtttatcaggaacgaagacataattatttataacacactcctcgggggcatcagcatgaaagacgaaaaaatccaaggactgaacgagcttatcaatctccacaaccagaagcacccgggcaagaaggtgcctttgctgaaggtgctgtataagcaaatccttggggattcacagactcactcctttgtggatgaccagtttgaggacgaccagcaggtgatcaacgcggttaaagccgtcactgacacgttctcagagaccttgctgggctctttgaagatcattatcaataatataggccattacgacctggatcggatctacatcaaagccggccaggacatcaccacactctcaaagcgggcgcttaatgactggcacattattaccgagtgtctggaatcggaatacgacgataaattccccaagaacaaaaagtccgacacgtacgaagaaatgcgcaatcgctatgtcaagtcattcaaatctttttccattggtcggctcaattctctggtcacgacttacacggagcaagcgtgtttcctcgaaaactacctcggcagctttggcggcgataccgacaagaattgtctgacagatttcacgaattcactgatggaagtggagcatctcctcaactcggaatatccggtgactaacagacttatcactgactacgagtcggttcgcatcctcaaacggcttctggattccgaaatggaagtgattcatttcttgaagccgttgttgggcaatggcaacgaatccgacaaggacctcgtgttttacggcgaattcgaagccgaatatgagaaactcttgcccgtcattaaagtgtacaatagggtccggaactaccttacgcggaaaccttttagcaccgagaagatcaagctgaacttcaacagccccacgctgctttgcggatggtcccaatcaaaggagaaggagtatatgggtgtcattctgagaaaggacgggcaatactacctgggaatcatgacgccgtctaacaagaagattttcagcgaagctccaaaaccggatgaggattgttacgaaaagatggtgcttagatatatcccgcatccatatcagatgctgcctaaggtcttcttctccaagagcaatattgcgtttttcaacccgtcagacgagatcttgcgcataaagaaacaagagagcttcaagaaaggtaaaagctttaatagagatgactgccacaaattcattgacttctacaaagattctatcaaccgccacgaggaatggcggaaattcaattttaagttcagcgatactgactcatacgaggacataagccgcttctacaaggaagtggagaaccaggcgttttccatgtcctttactaagatccccactgtgtacattgacagcttggtggacgagggcaaattgtacctttttaaactccacaataaggatttcagcgagcattccaaaggaaagcctaacctccacacggtctactggaatgccctcttcagcgagtacaatttgcaaaatactgtttatcagctgaacgggagcgctgaaatcttcttccgcaaggcctcaataccggaaaacgagcgggtcatccataaaaagaatgttccgataacaaggaaagtggccgagcttaatggaaagaaggaggtctctgtcttcccatatgacattatcaaaaacagaagatatacagtggataagtttcaattccacgtcccacttaagatgaatttcaaggcagatgaaaagaagagaatcaatgatgatgtcatagaagcgattcggtcaaacaagggtatccacgtgattgggatcgatcggggcgagcggaaccttctttacttgtctttgatcaatgaggagggcaggatcatcgaacagcgctctctcaatatcattgacagcggcgaaggccacacacaaaattaccgcgacctgcttgactctcgggaaaaggacagggaaaaggctagggaaaattggcaggagatccaggaaatcaaggacttgaagacggggtatctgagccaggctattcatacgatcacaaaatggatgaaggagtataacgccattatagtgctggaggatctgaatgataggttcacaaatggacgcaaaaaagtcgaaaaacaggtgtatcagaagtttgagaagatgctgatcgacaaactgaattattacgtggataaagatgaggaattcgataggatgggtggaacccatcgggcacttcagcttacagagaaattcgaaagctttcagaagctgggacgccaaacaggcttcatcttctacgtgcctgcgtggaacacctccaagcttgatccgacaaccggtttcgttgatttgctgtacccgaagtataaatctgtggacgccactaaggatttcatcaagaagtttgacttcatccgctttaattccgagaagaactatttcgagtttgggctgcactactccaatttcaccgaaagagctataggttgtcgcgacgagtggattctctgcagctacggcaatcgcatagttaactttagaaacgccgctaagaataactcttgggactacaaagagatcgatatcacgaagcagctgttggacctgtttgagaagaatggaatagatgtgaagcaggagaacttgatcgattccatttgcgagatgaaggataagcctttcttcaaatcactgatcgcgaatattaagcttatcctgcagatacggaacagcgcttccggtactgatatagattacatgatttcccccgccatgaatgacaggggagaatttttcgatactcggaaaggcctgcaacagttgccacttgatgcggacgctaacggcgcgtacaacattgcaaagaagggcttgtggatagttgatcagattaggaacacaacaggtaacaacgtgaaaatggccatgtcaaatcgcgaatggatgcactttgctcaggagtcacggctggcataa

SEQ ID NO: 175 - DNA, 3795 bp, Moraxella caprae DSM 19149
  Cpf1 (1)..(3795)
atgttgttccaagatttcacacatctttatccgctttccaagaccatgaggttcgagcttaaaccaattggaaaaacgctggaacacatccatgccaagaatttcctgtcgcaggatgagaccatggcagacatgtaccaaaaagttaaggccattctcgatgattaccaccgcgatttcattgcggatatgatgggcgaggtcaaacttaccaagctcgcagaattttacgacgtctacttgaagttccgcaaaaatccaaaggatgacggtctccagaagcagctgaaggacctgcaggcagtcttgcgcaaggagattgttaagcccatcggcaacggaggaaaatacaaagcaggctacgaccggctgtttggggctaaattgtttaaggacggcaaagagttgggcgacttggccaaatttgtgatcgcgcaagaaggtgagtcaagccccaagttggcgcatctggctcacttcgagaagttttccacttacttcacgggcttccatgataataggaagaatatgtactccgatgaggataagcatacggcgataacatacagactcattcacgaaaatttgccaaggtttattgataaccttcaaatattggccaccatcaaacaaaagcacagcgctctctatgaccagattattaacgagttgaccgcttcggggcttgatgtctcgttggcgagccaccttgacggctaccacaagctcctgacacaggaaggaataacagcgtacaatacacttctcggaggtatctccggagaagccggctcgcggaagattcaggggattaacgaactcatcaatagccatcataatcaacactgccacaagtccgagcgcatagcgaagcttagacctctccataaacagatattgtcagatgggatgggcgttagcttccttccaagcaagtttgccgacgactctgagatgtgccaggccgtcaacgaattttatagacactatgctgacgtcttcgctaaagtgcagtctttgttcgatggcttcgacgaccaccagaaagacgggatttacgttgaacacaagaacctcaacgagctctccaagcaggcctttggcgactttgccttgttgggcagagttctggatgggtactatgtcgatgtggtgaatccagagttcaacgagcgcttcgccaaggccaaaacggacaatgcgaaagcgaagttgacgaaagagaaggataagtttattaagggagtccactctctcgcgtctctcgaacaggccatagagcattacacagcaaggcacgatgatgaaagcgtccaggcgggcaaacttgggcagtatttcaagcacgggctcgccggggttgacaatcctatccagaaaattcacaataatcactcaacgattaaggggtttcttgaacgggagcgcccagccggggagcgcgcgctcccgaagataaagtccggtaagaatcctgagatgacccaactgaggcagctcaaggaacttctcgacaatgcgctgaacgtggcacacttcgccaaacttcttacaaccaagacaacactggataatcaggacgggaacttttatggcgaatttggcgccctctatgacgagttggctaagatccctaccctttataataaagttagggattacctctctcaaaagccgttcagcaccgagaaatataaacttaactttgggaatcccacccttctgaatggctgggacctcaacaaagagaaggataactttggcattatactgcagaaggatggctgctactatctcgccctccttgacaaggcacataagaaagtcttcgataatgcacccaatactgggaaaaatgtctaccagaaaatgatctacaagctcttgcctggcccaaacaaaatgttgccaaaggtgttttttgcgaaatcgaatctcgactattataatccgtcagcggaattgctggacaaatatgcccaggggacgcataaaaaggggaacaattttaatctgaaggactgtcatgcgctcatcgattttttcaaagccgggatcaataaacacccggagtggcagcattttgggttcaagttctcccccacatcctcctaccaggatctttctgatttctaccgcgaagtggagccacaagggtatcaggtcaaattcgtcgatatcaatgctgattacattaacgaacttgtcgagcaagggcaactgtatttgtttcagatatacaacaaggatttctcgccgaaggcgcacggtaagccaaatttgcatacgctctattttaaagccctttttagcaaggataacctcgcaaacccgatttacaagctcaacggcgaggctcaaatcttttacaggaaggcgtctctcgacatgaacgaaaccactattcaccgggccggcgaggtcctggaaaacaagaatccagacaacccgaagaagaggcagttcgtgtatgacattattaaggataaaaggtacacccaggataaattcatgctccacgtgcccatcactatgaacttcggggtccaggggatgacaattaaggagtttaataagaaggtcaatcaatccatccaacagtacgacgaagtcaacgtgatcgggatcgatagaggcgaaagacatttgctctatcttaccgtcataaacagcaagggagagatcctggagcaaaggtctctgaatgacatcaccaccgcttctgcgaacggtacacaaatgacaacgccataccacaagatcctggacaaacgcgagattgaacggcttaacgcaagagttggatggggtgaaattgagacaattaaagagctgaaaagcgggtacctctctcatgtcgtccatcagatatcgcaacttatgctgaagtacaacgccatagttgtgctcgaggatctcaatttcggctttaaacgcggcaggtttaaagtcgagaagcaaatctaccagaacttcgaaaatgcactcattaaaaaacttaaccacctcgttctgaaggacgaggctgacgacgagataggttcatacaagaatgcacttcaacttacgaataatttcaccgatctgaagtctataggcaagcaaacaggcttcctgttctacgttcctgcctggaacacctcaaaaattgatccagaaactggcttcgtggatttgctcaagccaaggtacgagaatatagcccagagccaggctttcttcggaaagtttgataaaatatgctataatgctgacaaagactatttcgagtttcacatcgactacgccaagttcactgataaggccaagaacagccgccagatctggaaaatttgttcacatggtgataagagatatgtctacgacaaaactgctaatcaaaacaagggtgccactaaggggatcaacgtgaatgacgagctgaagagcctcttcgctaggcatcatataaacgataagcaacctaacctcgttatggacatttgccagaataacgataaggagttccacaaatctttgatttaccttcttaagacactgttggcgctcaggtactccaatgcgtcgtccgacgaagacttcattttgagccccgtcgccaatgatgaaggaatgttcttcaatagcgcgcttgccgatgatactcaacctcagaatgctgatgcaaacggggcctatcatatcgctctcaaaggtctgtgggtcctcgagcaaattaagaattccgatgatctgaataaggtcaagcttgctattgacaaccaaacttggctcaatttcgctcagaaccgctaa

SEQ ID NO: 176 - DNA, 3708 bp, Anaerovibrio sp. RM50
  Cpf1 (1)..(3708)
atggtggccttcatcgacgagtttgtgggccaatacccggtcagcaagactctcaggtttgaagcgagacctgtgccagagactaaaaagtggctggagagcgatcagtgctccgtcctgttcaatgatcagaagagaaatgagtattacggcgtgctgaaagagctgttggacgactattatcgggcctacatcgaggacgctctgacctccttcacactggacaaagctcttcttgagaacgcttacgatctttactgtaacagggataccaatgcattttcttcttgctgcgagaaactgcggaaggatctggtgaaggcattcggcaatctgaaggattacctgctgggtagcgaccaattgaaggatctcgtgaagctgaaagcgaaggttgacgcaccagctgggaaggggaaaaagaagattgaagtcgatagccgccttatcaactggttgaacaacaacgcgaagtactcggcggaggaccgggagaagtatattaaggcaatagaaagctttgagggctttgttacgtatctgaccaactataagcaagctagagagaatatgttctcctcagaggataagagcacagccatagcgtttagagtgatcgatcagaatatggttacctatttcggcaacataaggatttacgagaaaatcaaggctaagtacccagagctctattctgctctcaagggatttgagaaattctttagcccgaccgcgtactccgagatccttagccaatctaagatcgatgagtacaattaccagtgcatcggacggcccattgacgacgcagatttcaagggcgtcaactcacttattaacgaataccgccaaaagaacggtatcaaggccagagagcttccagttatgtcgatgctctacaaacaaatcttgagcgaccgggacaatagcttcatgagcgaagtgattaaccgcaacgaagaggctatagagtgcgctaaaaatgggtataaagtttcctacgccctgtttaatgagctgctgcaactgtacaaaaaaattttcacagaagataactacggaaatatatacgtcaagacacagccactgactgagctctcacaggccctcttcggagactggagcattctccgcaacgctcttgataatggcaaatacgataaagacataatcaacctggcggagctggagaagtacttcagcgagtattgcaaggttctcgacgcagacgacgcggcgaaaatacaagataagttcaatctgaaggattattttatacagaaaaacgccctggatgcgactctccctgacctcgataagatcactcagtacaaaccccatctggatgcaatgttgcaggcaattcgcaaatacaagttgttctcgatgtataacggcagaaaaaaaatggatgtgccagaaaatggtattgatttctcaaatgagttcaatgctatctatgacaagcttagcgagttcagcatactgtacgaccggatccggaacttcgccaccaagaaaccttactctgatgagaagatgaaactctcctttaacatgccaacaatgctggctggctgggactacaataacgagacggcaaacgggtgcttcttgttcataaaggatggcaagtacttcttgggagttgcggactctaagtcgaagaacatattcgactttaaaaagaaccctcacctccttgacaagtactcaagcaaggatatttattacaaggtcaagtacaaacaagtttcgggctctgcaaaaatgctgccgaaagtcgtgttcgccggttcgaatgaaaagatcttcggacatttgatctcgaagaggatcctggaaataagagaaaagaaactctacacggctgcagcgggggatagaaaggccgttgctgagtggattgatttcatgaaatcggcaattgcaatccatccggaatggaacgagtacttcaaattcaagttcaagaatactgctgagtatgataatgctaataagttttatgaagacattgataagcaaacttactccctcgagaaggtggagattcctactgagtatatagacgaaatggtctcgcaacataagctctacctttttcaactgtatacgaaggacttctccgacaagaagaaaaaaaagggcaccgataacctccacactatgtattggcacggtgtctttagcgatgaaaatctgaaggctgtgacagagggtacgcaacctattattaaactgaatggggaagcggagatgttcatgcggaatccatcgatcgagttccaagttacccatgaacataataagccgatcgcaaacaagaatccgctcaataccaagaaggaaagcgtgttcaactacgatttgattaaggataagcgctacacagaacgcaaattctatttccattgcccgataaccctcaactttagggccgacaagccaatcaaatataatgaaaagataaaccgctttgttgagaataatccggatgtttgtatcatcgggatcgatcgcggagagcggcatcttttgtactatacagttattaatcaaacgggagatattctcgagcagggatcccttaataagattagcggaagctacacgaacgataagggcgagaaggttaacaaggaaaccgactatcatgatctgcttgataggaaggagaaaggcaagcatgtggcccaacaggcctgggaaacaattgagaacatcaaggaactgaaggccggataccttagccaagtcgtttataaacttacacaactcatgctccaatataatgctgtcatcgtgctcgaaaatcttaacgtcggctttaagcgcggcagaacgaaggttgagaaacaggtttaccagaagttcgagaaagctatgatcgacaaacttaattacctggtttttaaagaccgcggctacgaaatgaacggctcttacgcaaagggccttcagctcactgacaagtttgaaagctttgataagatcggcaagcaaaccggctgcatatactacgtgattccgagctacacctcccacatcgatcctaagaccggcttcgtgaatctccttaacgccaaattgcgctacgaaaatataactaaggcccaagacacaatccgcaagtttgattccatatcttacaacgctaaagctgattacttcgagttcgcctttgattacagatcattcggtgttgatatggctaggaacgagtgggtcgtctgcacatgcggagatctccgctgggagtattcagcaaagacgagagaaaccaaagcctactctgtcaccgaccgcctcaaggaactgttcaaagcgcatggcatagactacgtgggaggcgagaaccttgtttcgcatatcactgaagtggcagataaacacttcctgtccaccctcctgttttacttgcggctcgtgctgaagatgaggtacactgtctcgggcactgagaatgagaacgattttatcctctctccggttgagtatgctcctggaaagttcttcgattccagagaggccacgtcaaccgagcccatgaacgccgacgcaaacggtgcatatcacatcgcattgaagggtctgatgaccatccgcggcatcgaggatggaaagctgcataactacggtaagggtggtgagaatgccgcgtggttcaaattcatgcagaatcaggagtacaagaataacggataa

SEQ ID NO: 177 - DNA, 4005 bp, Succinivibrio dextrinosolvens H5
  Cpf1 (1)..(4005)
atgtcttcattgacaaagtttacaaacaaatattccaaacaacttactattaagaatgagttgatccctgtcggcaaaaccctcgaaaacatcaaggagaatgggcttatcgatggggatgagcagctcaatgagaattaccaaaaggctaaaatcattgtggacgatttcctccgcgatttcattaataaggctctcaataacacccaaatagggaattggcgcgaactggctgatgccctgaacaaagaagatgaagacaacattgaaaagcttcaagataaaattaggggtataattgtgtcaaaattcgaaacattcgacctgttctcctcatatagcattaagaaagacgaaaaaattatcgacgacgacaacgatgtggaggaggaggagctcgatcttggaaagaaaactagctcgttcaagtatatattcaaaaagaatctgttcaaactggttctgccttcataccttaagactaccaaccaagacaagcttaaaatcatctcgtcctttgataatttttctacatatttcagggggttcttcgagaacagaaagaatatttttacaaaaaagccaatatcgacatcgatcgcgtatcgcatcgttcatgacaatttccccaaattcctggataatatccggtgcttcaacgtgtggcaaaccgaatgtccgcagctcattgtcaaagcggataactacctcaagtctaaaaacgtgattgcaaaggacaagtcgcttgcaaactattttacagttggcgcgtacgattactttctgagccaaaacggtatagacttctataacaatatcattggcggtctccccgctttcgcggggcacgagaagatccaagggcttaacgaatttattaaccaagagtgccaaaaggactccgaacttaagtccaagctgaagaaccgccatgcgtttaaaatggctgtgctcttcaagcagatattgtctgaccgcgagaaaagcttcgtcattgatgagttcgagagcgatgcccaggtgatcgacgcagttaagaatttttatgccgagcagtgcaaagataataacgtcattttcaatctcctgaacctcatcaaaaacattgcctttctcagcgatgacgagcttgatggaatctttatcgagggcaagtacctcagcagcgtctctcagaagctgtattcagattggagcaagctccgcaacgacatcgaggatagcgccaattcaaagcaaggaaacaaggaactggcgaaaaaaattaaaaccaataagggagatgttgagaaggcgatctctaagtacgaattttctttgtcagagctgaactctatcgtgcacgataacaccaagttttccgatttgctgagctgcaccttgcacaaagtggcgtcggagaagttggttaaagtcaatgaaggagattggccaaagcatctcaagaacaacgaggagaagcagaagatcaaagaaccgctcgacgctttgttggaaatttacaacactctgcttattttcaattgcaagagcttcaataaaaacggaaacttttacgtggattacgaccgctgcatcaatgaattgagcagcgtggtttatctttataacaaaactcgcaactattgtacaaagaaaccttataataccgataaattcaagttgaacttcaactcgccacagttgggggaaggattctcaaagtcgaaagagaatgattgtctgacattgcttttcaagaaggacgacaactattacgtgggaattatacggaagggcgcgaagatcaattttgatgacacccaagctatcgcagataatacggacaactgcatttttaaaatgaattactttctcctcaaagatgccaagaagttcattccgaagtgctctatccaactgaaggaggtcaaggcccactttaaaaaatcagaggacgattatatcttgtcggacaaggaaaagttcgcttctccgctcgtgattaagaagtcaacctttcttttggctaccgcacatgtgaaggggaagaagggcaacataaaaaagtttcaaaaagagtactcgaaggagaaccccacagagtataggaactccttgaacgagtggatcgcattttgcaaggagttcctgaagacctacaaggcggccacaatttttgacattaccacgctcaaaaaagccgaggagtacgccgacatcgtggagttctacaaggatgtggataatctctgctacaaacttgagttctgtccgattaagactagctttatcgagaatttgatagacaatggtgatctttatttgttcaggatcaataacaaggatttcagctcgaagtctacaggcacaaagaaccttcataccctgtacctgcaggcgattttcgatgaaaggaaccttaacaacccaacaataatgctcaacggcggagctgaacttttctacagaaaggagtctattgagcaaaagaaccgcatcactcacaaagcggggtcaatcttggttaataaggtctgcaaggacgggacgtcacttgacgataaaatacgcaatgagatttaccagtatgagaacaaatttatcgatacactctctgacgaggcaaagaaggttttgcccaatgtgattaagaaggaggcgacgcatgatatcaccaaggataagaggttcacttctgacaagttcttctttcattgtcccctcactatcaattacaaagagggggacactaaacaattcaacaacgaggtcctttcctttctgcgggggaatccggacatcaatattattggcattgataggggtgagcgcaacttgatttatgtcacagttattaaccaaaagggcgagatactggacagcgtctccttcaacaccgtgacaaataaatctagcaagattgagcagactgtggattacgaagaaaagttggctgttcgggagaaggaacgcattgaggcaaagaggagctgggactcaatctctaaaatcgcgaccctgaaggaggggtatctctctgccatcgttcacgagatctgtctcctgatgataaagcacaacgcgatcgtcgtcctggagaatcttaatgccggtttcaagcggattagagggggcttgagcgagaagtccgtgtatcaaaaattcgagaaaatgttgattaacaagctcaattactttgtgtccaagaaggaatctgattggaacaagccgtcaggcctcctcaacggccttcaactttcggatcaatttgagagcttcgagaagctcggaatccaatccgggttcatcttctacgtgccagccgcttacacctctaagattgatcccaccacaggcttcgctaacgttctgaacctgtccaaagtccggaatgtcgatgcgatcaagtccttcttcagcaactttaacgaaatttcctatagcaagaaagaggcgttgtttaagttttccttcgacttggactccctttcgaagaagggtttctcgtcttttgttaagttctctaaatcgaaatggaatgtgtatacatttggcgaacggattataaagcccaagaacaagcagggctaccgggaggacaagaggataaaccttaccttcgaaatgaaaaagctccttaacgagtacaaagtctcatttgacctggagaacaacctcatcccgaacctgacgtctgccaaccttaaggatacattctggaaggagctcttttttattttcaagaccacactgcaattgcgcaattcagtgacgaatgggaaggaagatgtgctcatatcccctgtcaagaacgcgaaaggggagttctttgtgtctgggactcataacaagacgttgcctcaggactgtgacgccaacggggcctatcatatagcattgaaaggcttgatgatccttgagaggaacaacctcgtgagggaggaaaaggacaccaaaaagatcatggcgatctccaacgtcgattggttcgaatacgtccagaagaggcggggagtcttgtaa

SEQ ID NO: 178 - DNA, 3957 bp, Flavobacterium branchiophilum FL-15
  Cpf1 (1)..(3957)
atgacaaataaattcactaaccagtattcgttgtccaagacccttcggttcgagctcattccacaaggaaagacacttgagtttatccaagagaagggtcttctctcccaagacaagcagcgcgctgagagctatcaggaaatgaagaagacaatcgacaagtttcataagtatttcattgacctggctttgtcgaacgcaaaattgacgcacttggagacgtacctggaactctacaataagtccgcagagaccaagaaggagcaaaagtttaaagacgacttgaaaaaggttcaggacaatctccggaaggaaatagtgaaatcattctctgatggcgatgcaaaatcgattttcgccatcttggacaagaaggaattgatcacagtggaattggaaaagtggttcgaaaacaatgaacaaaaggatatatactttgacgagaagttcaaaacttttacaacatactttacgggctttcaccagaacaggaagaatatgtattcagtcgagccgaattcaactgccattgcctataggcttattcacgagaatctgcccaagtttctggaaaacgcgaaggcgttcgagaagatcaagcaggtcgagtcactccaagtgaacttccgggaactgatgggggaattcggcgatgaaggcctgatcttcgttaacgagctggaagaaatgttccaaatcaattactacaatgacgtcctcagccaaaacggcattactatttacaacagcataatatccggctttaccaagaatgatataaagtataaaggcctcaacgagtacatcaataattacaatcagacaaaggataaaaaggatcgcctgcccaaacttaagcaattgtacaagcagatactgtcggatcggattagcctgtccttcctccctgatgccttcacggacggcaaacaagtgcttaaggccatatttgatttctacaaaataaatctgttgtcctacaccatcgaagggcaagaggagtcccagaatttgcttctcctcattcggcagactattgagaatttgtcctccttcgacactcagaagatctaccttaagaatgacacgcatctcacgactatctcacaacaggttttcggagatttctctgttttctctacggcgctcaattactggtacgagacgaaagtcaatccaaagttcgagaccgaatactccaaggcgaatgagaaaaaacgcgagatcttggataaagccaaagccgtttttaccaaacaggattacttctcaatcgcctttctgcaggaggttctttccgaatatatactcacacttgatcacacgagcgatatagtgaaaaagcacagctcgaactgcatagcggactattttaagaatcatttcgttgcgaagaaggagaacgagaccgacaagaccttcgatttcattgccaacataactgctaaatatcaatgcatccaaggcatacttgagaacgctgaccagtacgaagacgagctcaagcaggatcaaaagctcatcgataatctgaagttcttcttggacgctattctggagcttttgcacttcattaagccactgcatctgaagtcggagtcgattactgaaaaggacacggcattttacgacgtcttcgagaattattacgaggccctctccctgctgacccctctttacaatatggttagaaattatgtgacacaaaagccttactccaccgagaagataaaactgaacttcgagaacgcccagctgctcaacggttgggacgcgaacaaagagggtgactatctgaccacgatcctgaagaaggacggcaattatttcctggctatcatggataaaaaacacaacaaggcgttccagaagtttcccgaaggcaaagaaaactatgagaagatggtgtacaaactcttgccaggggtgaataagatgctccctaaagtgttcttcagcaataagaatatcgcgtacttcaacccttcaaaggaattgctggagaattacaaaaaggagacacataagaagggggatactttcaacctcgagcactgtcacactctgattgactttttcaaggactcccttaacaaacatgaagattggaagtatttcgacttccaattcagcgagactaaatcataccaagacctttcaggcttttaccgcgaggttgagcaccagggctacaagattaacttcaagaatatagattcggagtatatcgatggcctcgtcaatgagggcaagctgttcctttttcaaatatactcaaaggacttctcccccttctcgaaaggaaagcctaacatgcatacactctactggaaggccctctttgaggaacagaatcttcagaacgtgatttacaagctcaacggacaagctgaaatcttcttccgcaaggcctccatcaagccgaaaaatataatcctgcataagaagaagatcaaaatagccaaaaagcatttcatagacaaaaagaccaagacctcggaaatcgttccggttcagacgattaagaatcttaatatgtactaccaaggtaagatcagcgagaaggagctcactcaagacgacttgcgctatatagacaatttttcaattttcaatgagaagaataagaccattgacattatcaaagataagcgcttcaccgtcgacaagttccagtttcatgtgccaatcactatgaatttcaaagctacaggcggaagctacataaatcagacggtgcttgagtatctccaaaataacccagaggtcaagataattggcttggaccggggcgagagacatctggtttaccttactctcatcgatcagcagggcaatatcctcaagcaggagtcactcaatacgatcacagattcgaaaatttccacaccctatcataagctgctcgataataaggaaaatgaacgggaccttgcgcgcaagaattggggcacagtggagaacattaaggagctgaaggaaggctacatctcacaagtggtgcacaagatcgcgactctcatgctcgaagagaacgccattgtggtcatggaagacctcaatttcggttttaagagaggccgcttcaaggtcgagaagcagatttatcagaagctggagaagatgctcatcgacaagcttaattatctggtgttgaaggataagcaaccccaagagctgggtggcctctacaacgcgcttcaactgactaacaaatttgagtcctttcagaagatgggtaagcagagcgggttccttttctacgtgccagcttggaatacaagcaaaatagaccccacaaccggtttcgtgaattatttctataccaagtacgagaacgtcgacaaagccaaggccttttttgaaaagttcgaggccattcgcttcaacgccgagaaaaaatacttcgagttcgaagtcaaaaagtactccgacttcaaccccaaggcggaggggacccagcaggcatggacgatctgcacatacggtgagcgcatcgagaccaagcggcagaaggaccaaaacaacaagttcgtgagcaccccgatcaatctcaccgaaaagatagaggacttccttggtaaaaaccagatcgtgtacggtgacgggaactgtattaagtcacagatcgcatcaaaggacgacaaggctttttttgagacccttctctactggttcaagatgactctccagatgcgcaacagcgaaacccgcacagatattgactacctcatttccccagtcatgaacgacaatggcacgttctacaactcaagggactacgagaagttggagaaccctactctcccgaaggacgccgatgctaacggagcctatcacattgctaaaaaagggctgatgctcctcaataagatcgatcaggctgatttgacaaagaaagttgacctttccattagcaatcgggattggctgcagttcgttcagaaaaacaaatag

SEQ ID NO: 179 - DNA, 3774 bp, Prevotella bryantii B14
  Cpf1 (1)..(3774)
atgcaaataaacaacctcaagatcatatatatgaagttcacagatttcaccggcctgtatagcttgtccaagactctcaggttcgagttgaagccgatcgggaagacactcgaaaacataaaaaaggcgggacttttggagcaagatcagcatagggcggactcctacaagaaggtgaagaaaatcattgatgaatatcacaaggcttttatagaaaagtcgctttctaatttcgaactcaaataccaatcggaagacaagctcgactcgttggaagaatatctgatgtactactcgatgaagagaattgaaaagaccgaaaaagataagttcgccaaaatccaggacaacctcagaaaacagatcgcggaccaccttaaaggcgatgagtcttacaaaacaatattttccaaggatttgatcaggaagaatttgccggacttcgtcaagagcgacgaggaacggactttgattaaggagtttaaggacttcaccacgtactttaaagggttctacgaaaatagagagaatatgtacagcgcggaggataaaagcaccgccatctcccatagaatcatccacgagaatctccctaagtttgtggataacataaacgcgttctccaaaataatcctcatcccagagctgcgggagaagctcaatcagatataccaggacttcgaagagtacctgaacgtggagtcaattgatgaaatattccatcttgactacttcagcatggttatgacacaaaagcagatcgaagtctataacgccattattggcgggaagtctaccaacgacaagaagatacaggggcttaatgagtatattaatctgtataaccaaaagcacaaagattgcaagttgccaaagctgaaactgttgttcaagcagattcttagcgaccggatagcgatctcttggctcccggataacttcaaggatgatcaggaggcgcttgactcaatagatacatgctacaagaatctcctgaatgacgggaacgtgcttggggaaggaaatctgaagctgctgctcgagaacatagatacatacaatctgaagggaatttttattagaaatgatctccaactgacagatatttcacagaagatgtacgcttcttggaatgtcattcaagatgcagttattcttgatttgaaaaagcaggtttcccgcaagaagaaggagagcgcggaagattacaacgatagactgaagaagctctatacgagccaggagagcttttcgatacagtacctcaacgactgcttgagggcgtacgggaaaacagaaaacattcaagattactttgcgaaactgggggcggtcaacaacgagcacgagcagacgatcaacttgtttgcacaagttaggaacgcctatacttccgttcaagccatcctcacaacaccgtaccctgagaatgccaacttggctcaggacaaagagaccgtcgcacttatcaagaacctccttgattcactgaagcgccttcaaaggtttatcaaacctctcctcggcaagggcgatgagagcgacaaggacgagcgcttctacggagacttcactcccctttgggagacgctcaaccaaataaccccattgtataatatggtgagaaactacatgacaaggaaaccttattcgcaggagaaaataaagctcaattttgaaaactctaccttgcttgggggatgggatctgaacaaagagcacgataatactgcaatcatacttcgcaagaatggtctttactacctggctatcatgaaaaaaagcgccaacaagatcttcgataaggacaaattggacaactctggcgactgttacgaaaaaatggtgtataaactgctcccaggcgccaacaaaatgcttcccaaggttttcttttccaagtcgcgcatcgacgagttcaaaccttctgagaacataatcgagaactacaagaagggaactcacaaaaaaggggccaacttcaatctcgcagattgccacaacttgatcgatttctttaaatcctctatatcgaagcatgaagactggtccaagttcaactttcatttcagcgacacctcatcttatgaggacctttcagacttctacagagaggtggagcaacaagggtactcaatctcattttgcgatgtcagcgtggagtacattaacaagatggttgagaagggggacctttacctcttccaaatctacaataaggatttctcggaattcagcaagggcacgcctaatatgcacacgctctattggaacagcctcttctcgaaagagaacctgaataatataatatacaaactcaatggccaagctgagattttcttcaggaagaagtcactcaattacaagcggccgacacacccggcgcatcaagctattaagaacaagaacaagtgtaatgagaaaaaagaatccatcttcgattatgacctcgtcaaggataagcgctacaccgttgataaatttcagtttcacgttccaattaccatgaactttaagtctacaggaaataccaatataaaccaacaggtcattgactatcttcgcacggaggacgatacgcacatcatcggaatcgatcggggggagcggcacctgctttatttggtggttatcgactcccatgggaaaatcgtggaacagttcaccctcaatgagattgtgaacgagtacggcggaaacatttatagaacgaattaccacgacttgctggacacgagagagcaaaacagggagaaagcgagggagtcatggcagacaatcgagaacataaaagaattgaaagagggctatatctctcaagtgattcataaaataacggatctcatgcaaaagtaccatgcagtcgtcgtgctcgaggatctcaacatgggattcatgaggggaaggcagaaggtggagaagcaggtctatcaaaaatttgaagaaatgctgatcaataaacttaattatctggtcaacaaaaaggctgatcagaatagcgctggagggctgttgcacgcctaccagctgacatcaaagttcgagtccttccagaaacttggcaagcagtctggttttcttttttacattccagcctggaatacctccaaaattgatcctgtcaccggatttgtgaacttgtttgacaccaggtacgagagcatagacaaggcgaaggcattctttggaaagttcgattccataaggtataatgcggacaaagactggttcgagtttgcgttcgactataacaacttcacaactaaagcagaggggactagaacaaattggacgatctgtacatacggttcaaggatcaggaccttcaggaatcaagcgaagaattctcaatgggacaacgaggagatcgatctgacaaaagcctacaaggcttttttcgccaaacatggaatcaatatctatgataatatcaaggaggccatagccatggaaactgagaaaagcttctttgaggacctgcttcatctgcttaaattgactctgcagatgcggaactccattaccggcacaaccactgattatctcatttcgccagtccatgactctaaaggaaacttctacgatagcaggatctgtgataatagccttcctgccaacgcggacgcgaacggcgcgtataatattgcccgcaaaggattgatgctcatacagcaaatcaaggattcgacgagctcgaaccgctttaagttctcacctattacgaataaagattggctcatttttgcacaagagaagccgtacttgaatgactga

SEQ ID NO: 180 - DNA, 3621 bp, Lachnospiraceae bacterium NC2008
  Cpf1 (1)..(3621)
atggagaattattacgactctctcacaagacagtatcccgtcacgaagacaattaggcaagagctcaagcctgtggggaaaacgttggagaatatcaagaatgccgagatcatcgaggcagataagcaaaagaaggaagcctacgtgaaggtcaaggaactcatggatgagttccacaagagcattattgagaagtcactggtgggaataaagttggacgggctctctgaattcgagaaactgtacaagattaagacaaagacggacgaggataagaaccggatcagcgagttgttctactatatgcggaagcagatcgccgacgcgctgaagaactctcgcgactacggctatgtcgacaacaaggatttgattgagaaaatactcccagaacgcgtgaaggacgagaactcgctcaacgcactctcatgctttaagggattcacaacttatttcactgactactataagaatcgcaagaacatttatagcgacgaggagaagcattccacggtggggtataggtgcatcaacgaaaatctcctgatattcatgtcaaatatcgaggtttatcaaatttataaaaaagccaatataaagaacgacaattatgacgaggagaccctcgataagacctttatgattgagtcatttaacgaatgtctgacgcaatcgggtgtcgaagcctataatagcgtcgtcgcctcaattaagacggcgacgaacctttacatccagaaaaacaacaaagaggaaaatttcgttcgggtgcctaagatgaaggttctcttcaaacagatcctgagcgacaggacgtcccttttcgacgggctcattattgagtctgacgacgaacttctcgataagctctgctcgttttctgcggaagtggataaatttctgccaataaacattgaccgctatataaagactttgatggattccaataacggtacggggatctatgtgaagaatgactcaagcctcacgaccctttcaaactatttgactgactcatggtcctccatccggaacgcgtttaacgagaactatgacgcaaagtataccggcaaagtgaacgacaagtacgaagagaagcgcgagaaagcctataagtccaacgactcattcgagcttaactatatccaaaacctcctgggaattaatgtcattgataaatacattgaacggattaacttcgacattaaggaaatctgtgaagcgtacaaagagatgaccaaaaactgctttgaagatcatgataaaacgaaaaaactgcaaaagaatataaaggcagtggcgagcataaagagctatctggattcattgaagaatatcgagcgggatatcaaactcctcaacggtacagggcttgagtctaggaacgaattcttctatggagaacagtccactgttcttgaggaaataaccaaggtcgacgagctgtataacatcacgaggaattacctcaccaagaaacctttctctaccgagaagatgaagctcaacttcaacaatccacagctcctcggagggtgggatgtcaataaagaaagggattgttacggggtgatcctgatcaaggacaataattactacctgggaatcatggataagtcggccaataagtcgtttctcaatataaaagaatcaaaaaacgagaacgcttataaaaaagttaattgtaaactcctcccggggccgaacaaaatgttcccgaaagtcttcttcgctaagtccaatattgattattatgatccaacccatgagattaagaaactgtatgacaaggggacattcaaaaagggcaacagctttaatctggaagattgtcacaagctcatcgatttttataaggagtcaatcaagaaaaacgatgattggaagaacttcaattttaatttctcagatactaaggactacgaggatatctccggcttttttcgcgaggttgaggcccaaaactacaagatcacctatactaacgtctcatgcgattttatcgaatccctcgtcgatgaggggaagttgtacctgttccagatttataataaagatttctccgaatacgccactggcaacctcaacctgcacacactgtacttgaagatgctgttcgacgagaggaacttgaaagacctgtgcatcaagatgaacggggaagccgaagttttttaccggcccgcgagcatcctggatgaagataaggtggtgcataaggccaatcagaagataacaaacaagaacacgaatagcaagaagaaggaaagcattttttcctacgacatcgtcaaggacaagcggtatactgtggacaaatttttcattcacttgcctataacccttaactataaagagcagaatgtttcaagattcaacgattacattcgggaaatcctcaagaaatcgaagaatatccgcgtgattgggattgaccggggagaaaggaatctcctttacgtggttgtttgcgattcagatggaagcatcctctatcaaagatccattaacgagattgtctctggctctcacaagaccgattaccataagctgctggacaacaaggagaaagagaggctctcaagcagacgggactggaaaacgatagaaaatattaaagatcttaaagcaggctatatgtcacaggttgtgaacgaaatatacaacctcatcctcaaatacaatgccattgtcgtgttggaggatcttaacatcggctttaagaatggcaggaagaaagtcgagaagcaggtgtatcagaacttcgagaaggccttgatcgataagctgaactacctgtgcattgataaaacgcgcgagcagttgtctccgtcgtcccctggaggagttctgaacgcctaccagctgactgctaagtttgagtctttcgagaagatcggtaagcagactggctgcatcttctacgtgcccgcctatttgaccagccagatcgaccctaccaccggattcgtgaaccttttttatcagaaggacacgtcgaagcaaggattgcaactttttttcagaaaattcaagaagatcaatttcgacaaagttgcgtccaacttcgagtttgtgttcgactacaacgattttacgaacaaggctgaggggactaagaccaactggaccatctctacccagggcactagaattgcgaagtatcgctctgatgacgcaaacgggaagtggatcagcagaactgtgcatcccacggatattataaaagaggcgctcaatagggaaaaaatcaattacaacgatgggcatgacctcatagatgagatcgtctccattgagaaatccgcggtgcttaaggagatttattatggcttcaaacttactcttcagctgcggaattcaacactggccaacgaggaagaacaggaggattatatcatttctccagtgaagaattcatcgggcaattacttcgactctcggattacgtccaaggaattgccgtgcgacgccgacgccaatggtgcttacaatatcgcaagaaaaggcctgtgggctctcgagcaaatacgcaactcagaaaatgtctcgaaggtcaaactcgcgatttcgaataaggaatggttcgagtacacacagaacaatatcccctcactctaa

SEQ ID NO: 181 - DNA, 3618 bp, Pseudobutyrivibrio ruminis
  Cpf1 (1)..(3618)
atgtactatcagaatctcacgaagatgtaccctatatctaaaacgctccggaatgagctcattccggtcggcaaaacactcgagaacataaggaagaatggaatacttgaagcagacatacagcgcaaagcggattacgagcacgtcaagaaactcatggacaactatcacaagcaacttatcaatgaagccctgcagggtgttcacctctcagatctttccgacgcatacgatctctatttcaacctgagcaaggagaagaactcggtggatgcattttccaaatgtcaggataagctccggaaggagattgtgtcgcttcttaaaaaccacgagaatttcccgaaaatcggaaataaggaaatcatcaaacttctccaatccctgtacgacaatgatacggactacaaggcgcttgactccttctctaacttttacacctacttctcatcatataatgaggtccggaagaacctttatagcgatgaggagaaatcctctactgttgcctacaggttgataaatgaaaatttgccgaagtttctcgataatattaaagcttatgccattgcgaaaaaggctggggtcagagcagaaggcttgtcggaggaggatcaggactgtttgttcattattgagaccttcgagcgcacccttacgcaggatggtatcgataattataatgctgctatcggcaagctgaacactgcaattaacctcttcaaccagcagaacaagaagcaagagggcttccgcaaagtgccacagatgaagtgtctctataaacagatcttgtcagaccgcgaggaggccttcatcgatgagttcagcgatgacgaggatcttatcacgaacatagagagcttcgctgagaacatgaacgtcttcctcaacagcgaaataatcacagattttaaaatcgcacttgttgaaagcgatggctcgcttgtctatataaagaacgatgttagcaaaacttcgttctccaatattgtgttcgggagctggaacgccattgacgagaaactgtctgatgagtacgacttggcgaacagcaaaaagaagaaggatgagaagtattacgagaagaggcagaaagagctcaaaaagaacaaatcctatgaccttgaaacaatcattgggctctttgacgataattcagacgtcatcgggaaatacattgagaagctggaatccgatataacagccattgccgaggctaagaatgacttcgacgaaatcgtgctgagaaagcacgacaagaacaagtccctgaggaaaaacactaatgcggtggaggccattaagtcatacctcgatacagtcaaggatttcgaacgcgacataaagctgatcaatgggtcgggacaggaagtcgagaagaacctcgtggtctacgccgagcaagagaacattttggcagaaatcaaaaatgtggatagcttgtacaacatgtctcggaattacctgactcagaaacctttctctaccgagaagttcaaattgaacttcaatagggcgactttgctcaatggctgggacaagaacaaggagactgataatcttggtattctgttcgaaaaggacggcatgtactatctcggcatcatgaatactaaggcgaacaagatcttcgttaatattccgaaagccaccagcaacgatgtttaccacaaggtgaattacaagctccttcccggcccaaataagatgctgccgaaggtcttctttgcccagtcgaatctggattattacaagccgtctgaagagctccttgcgaaatacaaggccgggacgcataagaaaggtgacaatttttcactcgaggattgtcatgccctcatagacttctttaaggcctctattgagaagcacccagactggtccagcttcgggttcgaattctcggagacctgcacctacgaggacctttctggtttctaccgggaagttgagaaacagggatacaagataacatatacggatgtcgacgctgattatattacgtctctcgtggagcgggatgagttgtacctctttcagatatacaacaaggatttttccccctattcaaaaggcaacctgaacttgcatacgatctaccttcaaatgctgttcgaccaaagaaacctgaataatgtcgtgtacaagcttaatggggaggccgaagtgttctaccggccagcctctattaatgacgaggaagtcatcattcacaaagcaggagaagaaattaaaaataaaaattcgaagcgcgcagttgataagcctaccagcaaatttggttacgatatcatcaaagaccgccggtattccaaagataagttcatgcttcacattccggtgacaatgaacttcggagttgacgaaacgcggcgctttaatgacgtcgttaatgacgcgctgaggaacgatgagaaggtgagagtcatcggaatcgacaggggggagaggaatctgctgtacgttgtcgttgtcgacacggacggtaccatcctggaacagatctcactgaattccatcatcaacaatgagtattccattgagacagattatcataagctcctcgatgagaaggaaggggacagggaccgcgcgaggaagaattggaccacgatcgaaaacattaaagaactcaaggaaggttatctgtcgcaagtcgttaacgtcatcgccaagctcgtcctcaagtataacgcgattatttgtctcgaggacctgaacttcggattcaagcggggcagacagaaggtcgagaaacaggtctaccagaagttcgaaaaaatgttgatagacaagctcaactaccttgttatcgacaagtcgaggaagcaagataagcctgaggaatttggtggcgccctcaacgcgctgcaattgacatctaagttcacgtcgttcaaagacatgggcaagcagaccgggataatctactatgtgcccgcgtacctcacatctaaaatcgatccaacgacgggctttgcaaacctcttctacgtgaagtatgaaaacgtggagaaggcgaaggaattcttctcacggtttgacagcatctcttacaataatgagagcggatattttgagttcgccttcgactacaagaaatttaccgatcgcgcctgtggtgctagatctcagtggacagtctgcacatacggcgaaaggataatcaaattccgcaatactgaaaagaataactccttcgacgacaagactatcgtgttgtctgaagaatttaaagaactgttctccatatacggtatttcctatgaagatggcgcagaactcaaaaacaaaattatgtccgtggacgaggcagatttcttccgctctttgaccaggctcttccaacaaactatgcaaatgagaaactcttcgaatgatgttacgagagattatataatctcgcctatcatgaatgatagaggcgaattcttcaactcagaggcttgcgatgcctctaagccgaaagatgccgacgccaatggcgccttcaatatcgcaaggaagggcctctgggttctcgaacaaatacggaataccccatccggagataagctcaacttggcgatgtctaacgccgagtggcttgaatacgcccagcgcaaccaaatctaa

SEQ ID NO: 182 - DNA, 3645 bp, Candidate division WS6 bacterium GW2011_GWA2_37_6 US52_C0007
  Cpf1 (1)..(3645)
atgaagaacgtctttggcgggttcacaaatctgtactcactcacgaaaacactcaggttcgagttgaagccaacatcgaaaacgcaaaaactgatgaagaggaacaatgtgatacagactgacgaggaaatcgacaaactctaccatgacgagatgaaaccgatcctggacgagattcaccggcggttcattaacgatgcgcttgctcagaaaattttcatttcagcctctttggacaattttttgaaggtcgttaagaactataaggtggagtccgcgaagaagaacataaaacaaaaccaagttaagctcctgcaaaaagaaatcactatcaagacgctggggttgcggagggaagtggtgtctgggtttatcaccgtgtccaagaagtggaaagacaaatacgtcggtctcggtattaagctcaaaggagatggatataaggttctcacagaacaggcagttctggatattctcaagatcgagttcccgaataaagccaagtacatagacaaattccgcggtttttggacctatttctctgggttcaacgagaaccgcaagaattactactcagaagaggacaaagcaacatcgatagcgaaccgcatcgtgaacgagaacttgtcgagatacatcgataatattattgccttcgaggagattctgcaaaagataccaaacctcaaaaagttcaagcaggatctggatatcacttcttataactactatctcaatcaagccggcatcgataaatacaacaagatcataggtggctatatagtggataaggacaagaaaatccagggcatcaacgaaaaagtgaatctctatacgcaacagaccaaaaagaagctcccaaagctgaaatttctttttaaacaaatcggctccgaaaggaaaggcttcggtatcttcgaaatcaaggaaggaaaagagtgggagcagctcggagatttgttcaagctgcagaggaccaagatcaattcaaatgggagagaaaagggcctctttgatagcctgaggaccatgtatagggagttcttcgacgaaattaaacgcgatagcaattcgcaggccaggtatagcctggacaaaatttactttaacaaagcttctgtcaatacgatttctaattcgtggtttaccaattggaacaaatttgcagaacttctcaacattaaggaggacaagaaaaacggggaaaaaaagattccggagcaaatttcaatcgaggacatcaaagactcactctccattatacccaaggagaaccttgaagagctgttcaagttgactaacagggaaaaacacgacagaactaggttctttggctctaacgcttgggtgacattccttaacatatggcagaatgagattgaggagtctttcaacaagcttgaggagaaagagaaggacttcaagaagaatgcagcaattaaattccagaaaaacaatctcgtccagaagaactacatcaaagaggtgtgcgatcggatgttggctatcgaaaggatggccaaataccatcttccaaaggactccaatcttagccgggaagaggatttctactggattatagacaaccttagcgaacaacgggaaatatacaaatactataatgcattcagaaattacatctctaagaagccctacaacaagtccaagatgaagctcaattttgagaatgggaatttgttgggtgggtggtcagatgggcaggaaaggaataaggccggcgttatcctccggaatgggaacaagtattacttgggcgtccttattaatcggggaattttcaggaccgacaagatcaataatgagatctaccgcacaggctcatcaaagtgggagaggctgatcctctcaaacctcaagttccagacactcgcaggtaagggttttctcgggaagcatggcgtctcgtatggcaacatgaatccagagaagtcagtcccctcactgcagaaatttatcagggagaattacctcaaaaagtatccccagctcacagaggtgtcaaatacaaagtttctgtccaagaaggacttcgacgcggcaattaaggaggcactcaaagagtgtttcacaatgaatttcattaacatagcggagaacaagctgcttgaggcagaggataagggcgacctgtacctctttgaaatcactaacaaggatttctccggcaagaaaagcggcaaggacaatatacatacaatctattggaaatacctcttctcggagtccaactgcaagtctccaataatcggtttgaacgggggcgccgagatcttctttcgggaggggcagaaagataagctccacactaagctcgacaagaaagggaagaaggtttttgacgcgaagcgctactcggaagataagctcttcttccacgtgtctataaccatcaactatggcaagccgaagaatataaaatttcgcgatatcattaatcaattgatcacgtcaatgaatgtcaacattatcgggatagacagaggagagaagcatcttctgtattacagcgtcatcgattctaatggcatcatattgaagcaagggtcattgaataaaatccgcgtgggagacaaagaggttgacttcaataaaaagttgactgagagagccaatgagatgaagaaggcccgccagtcctgggaacaaattggcaacattaaaaacttcaaagagggatacctgtcgcaagcgatccatgagatttaccagctcatgattaagtacaacgccattatcgtgctggaggatctcaatactgagtttaaggctaagcgcctcagcaaggttgaaaagtcagtttataagaagttcgaattgaaattggcgcgcaaactgaatcacttgattcttaaggacagaaatactaacgaaatagggggcgtgctcaaggcttaccagcttacaccgaccattggagggggagatgtgagcaagttcgagaaagcgaagcagtggggtatgatgttttatgtgagggctaactacacttccaccaccgacccggttaccggttggcggaagcatctgtacatttccaacttcagcaacaatagcgtcatcaagtctttttttgatccaaccaacagagacacaggtatcgaaatcttctattcggggaagtacagatcgtgggggttcagatatgttcaaaaggaaacaggaaagaaatgggaactttttgccacaaaggagctggagcgcttcaagtataaccagaccacaaagctctgcgaaaaaattaacctctacgacaagtttgaggagctttttaaagggattgataaatctgcggacatatattcccagctttgcaacgtgctggacttcaggtggaagtctctggtgtatttgtggaacctcctgaaccaaataagaaacgtcgataagaacgctgagggaaataagaacgattttattcagagccccgtgtatcctttcttcgacagcagaaagacggacggcaaaacggaacctatcaacggcgatgccaatggcgcccttaacattgcacggaagggcctcatgctggtggaacggataaagaataacccagagaaatacgaacaattgattagggacaccgaatgggatgcctggattcaaaatttcaataaggtgaactaa

SEQ ID NO: 183 - DNA, 3933 bp, Helcococcus kunzii ATCC 51366
  Cpf1 (1)..(3933)
atgttcgaaaagctctccaatatagttagcatttcgaaaacaatccgctttaaacttattcccgtcggcaaaacccttgagaatatagagaaactggggaagctcgagaaggatttcgagaggtctgatttctaccctatcctgaagaatatttcagacgattactacagacaatacatcaaagagaagctttctgatctcaaccttgactggcagaaactttacgatgcgcacgaacttctggattcgtcaaagaaggaatcacagaaaaatttggagatgatccaggcccaatataggaaagttttgttcaatatactgtccggcgagctcgataagtcgggcgagaaaaatagcaaagatctgattaaaaataacaaggctctctatggcaagctttttaagaagcaatttatcctggaggtgctgcctgatttcgttaataataacgactcttatagcgaagaggatctcgaaggacttaatctctactccaagtttacgacacggctgaagaacttctgggagacgcgcaaaaacgtgtttactgataaagatatagttaccgcaatacctttccgggcagtgaatgagaatttcggtttctactatgataacataaagatattcaacaagaacattgagtatctcgagaacaaaattcctaatctggaaaatgagctgaaggaggcggacattttggacgacaatcgcagcgtgaaggattacttcacgcctaacggcttcaactatgtgatcactcaagacggcattgatgtctaccaagctatccgggggggtttcacgaaggagaacggcgagaaggttcaaggcattaatgagatcttgaatctgactcagcagcagttgagacggaagcctgaaacaaaaaatgttaagctcggcgtgctgaccaagttgaggaaacagattctggaatattcagaatctaccagctttctgatcgatcaaattgaggatgacaacgacttggtggacagaattaacaaattcaatgttagcttcttcgagtccacggaagtgtcgccctctttgtttgagcagattgagaggctctacaatgctctgaagtctataaagaaggaggaggtctacattgacgcccgcaatacacagaagttttcacagatgctgtttgggcagtgggacgttatacgcagaggttacacagtgaagattacggagggctccaaagaagaaaaaaagaaatacaaggaatatttggagctggatgagacctctaaggcgaaacggtatctcaatattcgcgaaatagaagagctcgtcaacctcgtggagggcttcgaggaagtggacgtcttcagcgtgctgctcgagaaattcaagatgaataatatcgagcggtcagaatttgaggcgcctatttatgggagcccgattaagctggaagcaatcaaggagtacctggaaaagcatctggaagagtatcataaatggaagctcctcctcattggaaacgatgatttggataccgacgagacgttctacccacttctgaacgaggtgatttcagattattacattatccctctctacaaccttacaaggaattatctgacccgcaagcatagcgacaaggacaagataaaggtgaactttgacttccctaccttggctgatggatggagcgagtctaagatatctgataaccgctcgatcattctcagaaaggggggctactattacctcggtatcctcatcgacaataagctgctgattaacaagaaaaacaaatccaagaagatctacgaaatcctcatttataaccaaattcccgagttctcaaagtccatccctaactacccattcacgaaaaaggtgaaggagcatttcaagaacaacgtttccgactttcaacttatcgacggctacgtgagcccgctcattataaccaaggagatctacgatataaaaaaggagaagaagtacaagaaggacttctataaggataacaacacgaataagaactacctttataccatctacaaatggattgagttctgcaagcagtttctctacaagtacaagggcccaaacaaggaaagctacaaggaaatgtacgactttagcaccctcaaggacacaagcctttacgttaatttgaacgacttttacgcagacgtcaattcttgcgcataccgcgtgctgttcaacaagatcgacgagaatacgatcgataacgcggtcgaggacgggaagctcctccttttccagatatacaacaaggacttctctccagagtccaagggaaaaaagaatcttcacactctgtattggctctcaatgttttcggaggaaaacctgagaacaaggaagcttaagctcaatggtcaagcggaaatattctataggaagaagttggagaaaaagcccataatccataaagaggggagcatccttcttaataaaattgataaggaagggaacactatacctgagaatatctaccatgagtgctacaggtatctgaataagaagattggcagggaggatctgtcagatgaagccatagcgctcttcaataaggacgtgctgaaatacaaggaggcccgcttcgatatcattaaagaccggcgctacagcgagtcccaatttttcttccacgtcccgataacctttaactgggatatcaagaccaataagaatgttaatcaaatcgtgcagggcatgatcaaggacggtgagataaaacacattattggcattgacagaggggagagacatctgctttattattcagtgatcgacttggagggcaatattgtggagcaggggtccctgaacacacttgagcagaaccggtttgataactcaactgtgaaggttgactaccaaaacaagttgagaactcgcgaggaggaccgcgacagggcccggaaaaactggaccaacattaataaaattaaggagttgaaggacggctacctctcacatgtcgttcacaaactttcccgcctgataataaaatacgaggcgatcgttataatggagaaccttaaccaggggtttaagcggggtaggttcaaggtggagcggcaggtgtaccaaaagttcgaattggcgctgatgaacaagctctccgctctctcgttcaaagagaagtatgatgagaggaaaaaccttgaaccctcgggtatacttaaccctatccaggcttgttaccctgtggatgcgtaccaggagctgcaagggcagaatggcattgttttctatctcccagctgcttacacgtccgtcatcgatccagtcacgggctttaccaatctgtttcggcttaagagcatcaactctagcaagtacgaagagtttatcaaaaagttcaagaacatttactttgataatgaagaggaagacttcaagtttatcttcaattacaaagacttcgcaaaggcgaacctcgtgattctcaataacatcaagtccaaagattggaaaatttcgacacgcggtgagagaatctcctacaactcgaagaagaaggagtacttttatgtgcaaccgacggagttccttattaataaacttaaggaactgaacatagattacgagaatattgacataattccgctcatagacaacctcgaggagaaagccaagcgcaaaatcctgaaggcgctttttgatacattcaagtactccgtgcagttgaggaattatgattttgagaatgattacattatatctccgacagccgatgataatggcaactattataatagcaacgagatcgacattgataagacgaacctccctaataatggcgacgcaaacggagccttcaatattgcaagaaaggggctgctgcttaaggataggatcgtgaacagcaacgagagcaaagtcgacttgaagatcaagaatgaggactggattaatttcattatttcataa

SEQ ID NO: 184 - DNA, 3684 bp, Candidatus Methanomethylophilus alvus Mx1201
  Cpf1 (1)..(3684)
atggacgcaaaagagttcacgggccagtatcccctgtccaaaaccctcaggtttgagctcaggcccattggcagaacttgggacaacctggaggcatctggatacctcgcggaggacaggcaccgcgctgaatgctaccccagagcgaaggagctcctggacgacaatcatagggcgtttctgaatagggtgcttccccagatcgatatggattggcacccgattgccgaagccttttgcaaagtgcataaaaaccctggcaataaggagttggcgcaggactacaatttgcaattgtccaagcggcggaaagagatatcggcttacctgcaagacgccgatggttacaaaggactttttgctaagcctgctctggacgaggccatgaagattgcaaaggaaaacggtaacgagtcagatatcgaggtcttggaagcatttaatgggttttccgtttactttactggataccacgaatctcgggagaatatctactcggatgaggatatggttagcgtggcctacaggatcactgaagacaattttcctcgcttcgtgtccaacgccctcatcttcgacaaacttaatgagtcgcacccagatataatctcggaggtttcaggcaacctgggcgtggacgacattggtaagtatttcgatgtttctaattacaataacttcctctcacaggccggcatcgacgattacaatcacattataggcgggcataccacagaagacggcctcatccaggccttcaacgtcgttttgaatctgagacatcagaaggatcccgggttcgaaaagatacaatttaaacaattgtataaacagatactttcagtgcggacttcgaagtcctacataccaaagcagttcgataattcaaaggaaatggttgactgcatttgcgattacgtttcgaaaatcgagaagtccgagaccgtcgaaagggccctgaaattggtgcgcaacatttcctcattcgaccttcgcggaatcttcgtcaataagaagaaccttagaattctctccaataagctgattggggactgggacgctatcgaaactgccctcatgcattcaagctccagcgagaacgataagaaaagcgtgtacgacagcgcagaggcattcacattggacgacattttcagctcagtgaagaagttctcagacgcctctgccgaggatattgggaatcgggctgaggacatttgtagagtgatatccgagactgcacctttcatcaatgacctccgcgccgtcgatctcgatagccttaacgacgacggatacgaagccgccgtctcaaagattcgcgaaagcctggagccatatatggatctctttcacgaactcgaaattttttccgtgggtgacgagttcccgaaatgcgctgccttctactcggaactggaggaagtgagcgagcagctcatcgagattattccattgtttaataaagcgagaagcttttgcaccaggaaaagatattctacagataagataaaggtgaacctcaaatttcctactctcgccgacggttgggatctcaataaggaaagggataacaaggccgccatacttagaaaggatggtaagtattacctggcaatcctcgatatgaaaaaggatttgtcctcgatcaggacttccgacgaggacgaatcatccttcgagaaaatggagtataagcttttgccgtcaccagttaagatgctgcctaagattttcgtgaagtcaaaggccgctaaagagaaatatgggctcactgatagaatgctcgaatgctacgataagggtatgcacaaatccggctcagcgttcgatttgggtttctgccatgaactgatcgattactataagcgctgcatcgcagagtatccgggctgggacgtcttcgactttaagtttcgcgagacgtcggactatggctctatgaaggagtttaacgaggacgtggcgggcgccggttattatatgtccttgaggaagataccgtgcagcgaagtttaccgcctcctggatgagaaaagcatttatctcttccaaatatacaataaggactattccgagaacgctcacggtaacaagaatatgcacactatgtattgggagggcctcttctcgccccagaacctggagtcacctgtcttcaaactgagcggcggcgcggaactgttttttaggaagagctctatccccaatgacgcgaaaaccgttcatccaaaaggaagcgtgctggtccccagaaacgacgtcaatggaaggaggatccctgatagcatttatcgggagctgactaggtactttaatcgcggtgactgtcggatatctgacgaggcgaaatcctacctcgacaaagtcaaaacgaagaaggcagaccatgacatagttaaagacaggaggttcacagtggataagatgatgttccatgttccgatcgctatgaatttcaaggccatatccaaacctaaccttaacaaaaaggtgatcgacggcattattgatgaccaagacttgaaaatcattggcattgaccgcggggagcggaacttgatatatgttaccatggtcgacaggaagggaaacatcctttatcaggactccttgaacattctcaacggctacgactataggaaagcgctggatgtccgggagtacgacaataaagaggcgaggagaaattggacaaaagtggaaggcattcgcaaaatgaaggagggctatctgtccctcgcagtttcaaaactcgccgatatgattattgagaacaacgctataattgtgatggaagatcttaaccatggctttaaggccggtcgcagcaagattgagaaacaggtgtatcagaagttcgaatccatgctgatcaacaagctcggatacatggttttgaaggataaatctattgaccagtctggaggagccttgcacggttaccagttggccaatcacgtgacaacacttgcgagcgtcggaaagcagtgcggagtgatattctacattccggcagcctttacgtcaaagattgaccccactaccggattcgcagaccttttcgccctctctaacgtcaagaacgtggcgagcatgagggagtttttcagcaagatgaagagcgttatatacgacaaagccgaaggaaagttcgcctttacattcgattatcttgactataacgtcaagtccgagtgcggcagaacattgtggactgtctacacggtgggcgaaaggtttacgtacagccgcgtcaatagggagtatgtccgcaaggtccccacagatatcatttacgatgcactgcagaaagctggcatcagcgtggagggagatcttcgcgaccgcatcgctgagagcgacggggacacccttaagagcatcttctacgcgttcaaatacgctctcgatatgagggtggagaacagggaagaagactacattcaatccccagtcaagaatgcgtcgggggagtttttttgttcgaagaatgctggaaagtcattgccgcaagactccgacgcgaacggcgcgtacaacatcgctctcaagggaatccttcaactcagaatgctgtctgagcagtacgacccgaacgctgagtccatccggctcccgttgatcaccaacaaggcgtggcttactttcatgcagtctggaatgaagacttggaagaactaa

SEQ ID NO: 185 - DNA, 3195 bp, Smithella sp. SCADC
  Csm1 (1)..(3195)
atggagaagtacaagataacgaagacgatcagatttaagctgctgccggacaaaatacaggatatctccaggcaagttgcagtgctccagaactccacgaacgccgagaagaagaataatttgcttcgccttgtgcaacgggggcaagaactgccaaagctccttaatgagtacatcaggtattccgacaaccataagttgaaaagcaacgttacagtccattttagatggctgcgcctgttcaccaaggatctcttttacaactggaaaaaggacaacacagaaaagaaaataaaaattagcgacgtcgtctacctttcccacgtgtttgaggcatttcttaaagaatgggaatcgacgatcgagcgcgtcaatgctgactgcaacaagccggaggagtctaaaacgcgggacgctgagatcgcactcagcatcaggaaactcggcataaagcaccagctccctttcataaagggctttgttgataattctaatgacaagaactccgaggatacaaagtctaagctcacggcactgctgtctgagtttgaggcggtcttgaagatctgcgaacagaattatctgccctcgcaatcatcaggaatagctattgctaaggcatccttcaattactacaccatcaataagaaacaaaaagactttgaggcggagatcgtcgccctcaagaagcaactccatgcgagatacggaaataaaaaatacgaccaactgctgagggagctcaaccttataccacttaaagagctccccttgaaggagttgccgctgatcgagttttattcggagattaagaagagaaagtctacaaagaagtccgaatttttggaagccgtttccaatggtcttgtgtttgatgaccttaagtcaaagttccccctgtttcagacggagtcaaataagtatgacgagtacttgaagcttagcaataagattactcagaaatcaacagctaaatccctcctctcaaaggattcaccggaggcccagaagcttcagactgagattaccaaactcaagaagaatcgcggtgagtattttaagaaggcgtttggcaaatacgtgcagctgtgcgaattgtataaggaaattgcagggaaaagaggcaagctcaaggggcaaataaaggggattgaaaacgagcggatagatagccagaggctgcagtactgggctttggtgctcgaggacaatcttaagcactccctgatcctgattcccaaggaaaagacaaacgagctgtacagaaaggtttggggagcaaaggatgacggcgcatcctcctcctcatcatcgaccctctactacttcgagtccatgacgtacagagcacttagaaagttgtgcttcggcatcaatggtaacactttccttccagaaattcagaaggaacttccgcaatacaaccaaaaggagttcggcgaattctgcttccacaagagcaatgacgataaggagattgatgagccgaagcttattagcttttatcagtccgttctcaagactgatttcgtgaaaaacacacttgcgctcccccaatctgtgttcaacgaggtcgccatccagagcttcgaaacacgccaggatttccaaatagccctcgaaaaatgctgctacgcaaaaaaacagatcatttcagagtccctcaaaaaggaaattctcgaaaactacaacactcagatcttcaagattacctccctcgacctgcagaggtccgaacagaaaaatcttaaagggcacacgcgcatttggaatcgcttctggactaagcaaaacgaggaaattaattacaatctcaggcttaatcctgagatcgcaattgtgtggaggaaggcaaagaaaactaggatagagaaatacggagagcggtcggtcctgtacgagcctgagaagcgcaatcggtatcttcacgagcaatacacactgtgcacaaccgttactgataatgctctcaacaacgagatcacatttgcgtttgaagacacaaagaagaagggcacggaaattgttaaatacaacgaaaaaatcaaccaaacgctcaagaaggaatttaacaaaaaccagttgtggttttacggaattgatgccggcgaaattgagcttgccacacttgcacttatgaacaaggataaggagcctcaactcttcaccgtgtatgagctcaagaagttggactttttcaagcacggctacatttacaataaggaaagggagctcgtgattcgggagaagccttacaaggctatccagaatctcagctacttcctcaatgaggagctgtacgaaaagacctttcgcgatgggaagtttaacgagacttataatgaactcttcaaggaaaagcatgtgtccgcaattgacctgactacagccaaggtcataaacggcaagataattctcaacggtgacatgatcacttttctgaacctccggatccttcatgcgcaacggaaaatctacgaggagctgattgagaatccgcacgcagagttgaaggaaaaagactacaaactgtattttgagatcgaggggaaggataaggacatctatatctcacgcctcgactttgagtacatcaagccgtatcaagagatatccaactatctttttgcatactttgcatctcaacagatcaacgaggcgagggaggaagaacagatcaaccaaaccaaacgcgccctggcagggaacatgattggggtcatctattacctctaccagaagtacagaggtattatatctattgaggaccttaagcaaaccaaggtcgaatccgacaggaacaaattcgaggggaatatcgagcgccctctcgagtgggcgctttatagaaagttccagcaggaaggctacgtgcctcctattagcgagctcatcaagttgagagaacttgagaagttcccgctcaaggatgtcaagcaaccaaagtacgagaacatccagcagttcggcataatcaaatttgtgagcccggaagaaacttctacgacttgtcctaaatgcctccgccgcttcaaggactacgacaaaaacaagcaggagggcttctgcaagtgccaatgcggatttgacacgcgcaacgacctgaaagggttcgaaggtctcaacgacccagataaggtcgctgcgttcaacattgcgaagcgcggtttcgaggatcttcagaagtacaagtaa

SEQ ID NO: 186 - DNA, 3699 bp, Sulfuricurvum sp. PC08-66
  Cpf1 (1)..(3699)
atgcttcacgctttcactaatcagtatcaactttctaaaacattgagattcggagcaactctgaaagaagacgagaaaaaatgcaagagtcatgaggaacttaaaggatttgtagatatttcatatgaaaacatgaaatcttccgctacaatcgctgaaagtttgaacgaaaatgaacttgtgaaaaaatgcgaaaggtgttattctgagatcgtgaaatttcataacgcttgggagaaaatctactacaggacagatcaaattgctgtctataaagatttctataggcaactgtcaagaaaagctagatttgatgccggtaagcaaaattcacaactgataaccttagcttccctttgcggtatgtaccaaggagctaagttaagtagatacataaccaattattggaaagataacattactaggcagaaatcatttcttaaagatttttcccaacagttacatcaatacactcgtgcactggaaaagtctgataaggctcatacaaaacctaatctgatcaacttcaataagacctttatggtgttggccaatctcgtgaacgaaatagttattcctctttctaatggagccatctcttttccaaacatctctaagctggaggacggggaagagtcccatcttatagaatttgcactcaatgactattctcagttgtctgaattaattggtgaattgaaggatgcaatagccactaacggtggttacacaccatttgcaaaggtgacccttaatcattatacagcagaacagaaaccacacgtatttaaaaatgatattgatgctaaaatacgtgagcttaagttgattgggttggttgagaccttgaaaggaaaatccagtgaacagattgaggaatacttctcaaatttagacaagtttagcacatacaacgataggaaccaatcagtaatcgtaagaactcaatgctttaagtataaacccattccttttttggttaagcatcaacttgcaaagtacatttcagaaccaaacggttgggatgaagacgccgtagctaaggttctggatgctgttggagctattcgttctccagcacatgattacgctaataaccaagaggggtttgatttaaaccattatcctattaaagtcgctttcgattatgcttgggagcagttggctaattctttgtataccaccgtgacttttccccaagaaatgtgcgaaaaatatttaaatagtatctacggttgtgaagtctccaaggagcctgtatttaaattctatgctgatctgctttatatcaggaagaatctggctgtactcgaacataagaacaatctgcccagtaatcaggaagagttcatatgtaagatcaacaacacatttgagaacatcgtgttaccatataagatttctcaatttgaaacttataagaaggatatacttgcctggataaacgatgggcatgaccataaaaaatatactgatgcaaaacagcaattaggttttattaggggtggactcaagggtaggattaaggcagaagaagtgtcccagaaagacaaatatggaaaaatcaagtcttattatgagaacccttacactaaactcaccaacgaatttaagcaaatatcctctacttatgggaagaccttcgctgagttaagagacaaatttaaagagaagaatgagatcaccaaaattacccacttcggtattataatagaagataaaaacagagacagatatttacttgcaagcgagttgaagcacgaacaaatcaaccacgtcagtactatccttaacaagttagataaatcatctgaatttattacctatcaagttaagagccttacaagcaaaacattgattaaattgattaaaaatcacaccacaaagaagggagccatttcaccatatgctgattttcacaccagtaaaaccggattcaacaagaatgaaatcgaaaagaattgggataattataagagagaacaggtattggttgagtatgtcaaagattgtctgaccgatagtactatggcaaaaaaccagaactgggcagagttcggttggaattttgagaaatgcaactcctatgaggatatcgaacacgaaatcgaccaaaaatcatatttgctgcagagcgatacaattagcaagcagagtattgcttccctcgtggaggggggctgtcttctccttcctataattaaccaagatataacaagcaaggagaggaaggataaaaatcaattttcaaaagattggaaccatattttcgaaggttccaaagaattccgtctccacccagagttcgcagttagctacaggacacctattgaagggtatccggtacagaagaggtacgggcgtctgcagttcgtttgcgcttttaatgcacacatcgttccacaaaatggtgagttcatcaatttgaaaaagcagatcgagaactttaacgatgaagacgttcagaaacgtaatgtgactgaattcaataaaaaggtgaatcatgcactttccgacaaagaatacgtcgttattggtattgatagaggcctcaaacagcttgccacactctgtgttttagacaaaagaggtaaaattcttggagattttgagatctacaaaaaggaatttgtgcgtgctgaaaaaagaagcgagagtcattgggaacacacacaagcagaaaccagacatatcttggatctttccaatttgcgtgtggagacaacaatagagggtaaaaaggttctcgtggaccagagcctcacacttgtgaaaaagaatcgtgatacaccagatgaggaagctactgaagaaaataaacagaaaatcaagttgaagcagctcagctatattagaaaattgcagcataagatgcagactaacgaacaggacgttttagatttaattaataatgaaccatcagatgaagaatttaagaaaagaatcgaggggcttatttccagttttggagaaggacagaagtacgctgaccttccaattaatactatgagagaaatgatctctgatctccagggagttatcgctagaggaaacaaccaaacagagaaaaataaaattattgaattagatgctgcagacaaccttaaacaaggtattgtagctaacatgatcggaattgttaattacatcttcgctaagtattcatacaaggcttacatctctcttgaggatttgtcaagagcctatggaggtgcaaagtccggttatgacggaaggtatctgccatcaacttcacaagacgaggatgtagatttcaaggaacagcagaatcagatgcttgcaggtttgggtacctaccaattcttcgagatgcagcttctgaaaaaacttcaaaagattcagagtgataacaccgttctgagattcgtgcccgctttcagatctgcagataactatagaaatattttgagacttgaggaaactaaatataagtctaagccgttcggcgttgttcatttcatagatccaaagtttacatcaaagaaatgccccgtctgtagcaaaacaaatgtatacagggacaaggatgacatcttggtttgcaaagagtgcggttttaggagcgactcccaattaaaagaaagagagaataacattcattatattcacaacggggacgataacggtgcataccacatcgcccttaagagcgttgagaatcttattcagatgaagtaa

SEQ ID NO: 187 - DNA, 3744 bp, Uncultured bacterium (gcode 4) ACD_3C00058
  Cpf1 (1)..(3744)
atgtttaaaggtgatgcgtttacaggcctgtacgaagttcaaaagacccttagatttgagctcgtgcctatcgggctgacgcagtcatacctcgagaacgattgggttatacagaaagataaggaggtggaggagaattacggtaagatcaaagcctactttgatctgatccacaaggaattcgttcgccaatcacttgagaacgcctggctctgtcaactcgatgatttctatgaaaagtacattgagctccacaatagcttggaaacgcggaaagacaaaaatcttgcaaagcagttcgaaaaggtcatgaagagcttgaaaaaggagttcgtttctttctttgatgcaaagtggaacgaatggaaacaaaaatttagcttcctgaagaagtggtggatcgacgtccttaacgagaaagaggtcctggacctgatggccgaattctacccggacgaaaaagagctctttgataagttcgataagttctttacttatttcagcaacttcaaggagtccaggaagaacttctatgcggatgacggccgcgcctgggctatcgcaactagagcgattgacgagaacctcatcacatttatcaaaaacatcgaagacttcaagaaattgaactcgtcctttagggagtttgtgaacgataacttctcagaggaagataagcagatctttgagatagatttttacaacaactgcctccttcagccttggattgataaatacaataaaatcgtgtggtggtatagcctggagaattgggaaaaggttcagtggctgaacgagaaaattaacaactttaagcaaaaccagaacaaatctaactcgaaagacttgaagttcccaaggatgaaactcctttacaagcaaatactcggcgacaaggagaagaaagtgtatattgatgagatcagagatgataagaatttgattgacctcatcgacaactcaaagaggcggaaccaaatcaagatagataatgcaaatgatattatcaatgatttcatcaataacaatgcgaaattcgagctggataagatttacttgactcgccagtctattaacaccatctcaagcaagtatttttcttcgtgggactacatacggtggtacttctggacgggggaattgcaagaatttgtgagcttttacgacctgaaggaaacattttggaagatcgaatacgaaacacttgagaacatattcaaagactgttatgttaagggaatcaataccgagagccaaaataacattgtttttgagacccaaggaatctatgaaaacttcctcaatatatttaaatttgaatttaaccaaaatatatcccaaatttcactgttggagtgggaacttgacaagattcagaacgaggacattaagaaaaatgagaagcaggtcgaggtcattaaaaactatttcgattcagtcatgtcggtctataagatgacaaagtatttcagcttggagaagtggaagaagcgcgtggaactggatacagataataacttttacaacgactttaacgaataccttgaggggtttgagatttggaaggactataacctcgtcagaaactacattacgaaaaagcaggtgaacacagataagatcaagcttaacttcgataatagccaattcttgacgtggtgggacaaggataaggagaacgagcgcctgggtattattcttcggagggaatggaaatactacctctggattctgaaaaaatggaacactctgaatttcggcgattatttgcagaaggagtgggaaatcttctacgagaaaatgaactataaacaactgaataacgtctacagacagctcccgcggttgttgttcccattgaccaagaagttgaatgagctcaagtgggatgaactgaagaagtacttgtcgaaatacattcagaacttctggtataatgaggaaatcgcccaaatcaagatagaattcgatattttccaagagtccaaggaaaagtgggaaaaattcgatatcgacaagctccgcaagcttattgagtactacaagaaatgggtcctggctctttactccgacctgtacgatttggagttcattaagtacaagaattacgatgacctgagcattttctattcggatgtggagaagaagatgtacaacctcaactttactaagattgataagtctctgatcgacggcaaggtgaagtcgtgggagttgtacctcttccaaatctataataaggattttagcgagagcaagaaagaatggtctacggaaaatattcacactaaatatttcaagctgctcttcaacgaaaagaaccttcagaatctggtggttaaactcagctggtgggcagacatattctttagggacaagacggaaaatctgaagttcaagaaggataaaaatggacaagaaatccttgatcatagacgctttagccaggacaagattatgttccacatctccatcactctcaacgcgaactgctgggacaaatactggtttaatcagtatgtgaacgaatacatgaacaaagaaagggacatcaagattatctggatcgatcgctgggagaagcacctggcgtactattgcgtgattgacaaatcttggaagatctttaataatgaaatctggaccctcaacgaattgaactgggtcaattatctggaaaagcttgagaagatcgaatcctctaggaaagattcgaggatatcatggtgggagatcgagaatattaaggagctcaagaacgggtacatttcgcaagtgatcaataagctcactgagttgatagtcaagtacaacgcaattatcgtcttcgaggatctgaatatatggtttaaaaggtggaggcaaaaaatcgagaaacagatttatcaaaaacttgaactggccctcgcgaagaagcttaattatctcacacagaaggacaagaaggacgacgaaatattgtggaatctcaaggcgctgcagttggttcctaaagttaacgattatcaagacatctggaattacaagcaatcttggattatgttctacgtccgggcaaactacacatcggtcacatgtcccaattgctggcttagaaaaaatctgtatatctcaaatagcgccaccaaagagaatcaaaagaagtcacttaatagcatcgcgataaagtacaacgactggaaattttctttctcgtacgaaatcgacgacaaatcctggaagcagaagcagtcacttaacaagaaaaagttcattgtgtactcagatatcgagaggtttgtttattctccgctggagaaactgaccaaggtgattgatgtcaataagaagctccttgagttgttccgcgatttcaacctctcacttgatataaacaagcaaatacaagagaaagacctcgacagcgtcttcttcaagtctctgacgcacttgttcaatctgattctgcagctccggaattctgatagcaaggataataaggattacatctcgtgcccctcttgctactatcattctaacaactggctgcaatggttcgaatttaactgggatgcaaattgggcctacaatatcgctagaaagggtatcattctgctggatagaattcggaagaaccaggagaagcccgatctgtacgtctccgacattgattgggacaattttgttcagtctaatcagtttcccaacaccatcatccctattcaaaatatcgagaagcaggttccacttaatataaaaatctaa

SEQ ID NO: 188 - DNA, 3789 bp, Bacteroidetes oral taxon 274 str. F0058
  Cpf1 (1)..(3789)
atgagaaagttcaacgagtttgttggcctttaccccatcagcaaaactcttaggttcgagctcaaaccgatcggcaagacgttggaacacatccagcgcaataagttgttggagcatgatgctgtgagggcagacgactatgtgaaggttaaaaagattattgacaagtaccacaaatgtcttatagatgaagcactctctggctttacgttcgacacagaggcagacgggaggtctaacaattctctttcggaatattacctctattacaacctgaagaaaagaaacgagcaggagcagaagacctttaagactatccagaataatttgcgcaagcagatcgtgaataagctgacccagtccgagaaatataaacgcattgataaaaaagagctgatcacaactgacctgccggatttcctgacaaacgaatcagagaaggagctggtcgaaaagtttaaaaacttcaccacatacttcacggagtttcataaaaataggaagaatatgtacagcaaggaagaaaaaagcacggccatcgcgtttagacttatcaatgagaatctgccgaagttcgtcgacaacatagcagcgttcgagaaagtggtctcatcaccgttggcggaaaaaatcaacgctctctacgaagacttcaaggaatacctgaatgtggaagagattagccgggtctttcgcctggactactatgacgagctcctcactcaaaaacaaatcgacctgtacaacgctatagttggcggtaggactgaagaggataataagattcagatcaaggggctcaaccaatatatcaacgagtacaaccagcaacagaccgataggtccaaccgccttccaaaactcaaacctctgtacaaacaaatactttccgacagggagtcagtctcatggctgccccccaaattcgattcagataaaaaccttcttataaaaatcaaggagtgctacgatgccctttccgagaaggagaaagtcttcgataagcttgaatcgattttgaagtcattgtccacttatgacctttcgaaaatttacatctcaaacgattcgcagctttcttacatctctcagaagatgttcggcaggtgggatatcatttctaaggctataagggaggactgcgccaagagaaacccgcagaaatcaagagaaagcctggaaaagtttgctgagcgcatcgacaagaagttgaagaccatagattcaatcagcataggtgatgtggacgagtgcctcgcgcaattgggggaaacgtacgtgaaaagagtcgaggactacttcgtggccatgggcgaatcagagattgatgatgagcagacggataccacatctttcaagaaaaatattgagggcgcttacgaatctgtgaaggagctcctgaacaacgccgataacattacggataacaatctgatgcaagataagggtaatgtggagaagattaagaccctgctggatgcgatcaaggacctccagcggtttattaaaccgcttcttggaaagggtgacgaggctgataaggacggcgtcttttacggagagttcacgtccctctggactaagctcgaccaagtgacaccactttataatatggttcggaactacttgacatcgaaaccttactcgacaaaaaagatcaagttgaatttcgagaattctacactcatggatgggtgggacctgaacaaagagccagacaataccactgtgattttctgtaaggacggcctctactatctgggcatcatgggcaaaaagtataacagagtgtttgttgacagggaggatctgccacatgacggagagtgctatgataagatggaatataagttgcttccgggtgccaataagatgttgcctaaagtcttcttctctgagacgggcatccagaggttcctcccgtctgaagaacttctcggcaagtatgagagaggaacgcataaaaagggtgcaggcttcgacctcggcgactgccgcgctctcatcgacttcttcaaaaaatcaattgagaggcatgatgattggaagaagttcgatttcaaattttcagatacttccacctatcaagacatttcggagttttaccgcgaagtcgagcaacagggatacaagatgtcgttcagaaaggtgtccgtcgactacataaagtcgcttgtggaagagggaaagctctatcttttccagatctataataaggatttctccgcccactcgaagggcacaccaaatatgcacacgctctattggaagatgctctttgacgaagaaaaccttaaggacgtggtttacaagctgaacggggaggctgaggtgtttttcaggaagtcttcgatcacagttcagtcaccgacgcacccggcaaattctcctatcaaaaataagaacaaggacaaccaaaaaaaagaatccaaattcgagtatgaccttatcaaagatcgccggtacacagtcgataagttccttttccacgtgcccatcacgatgaacttcaagtcggttggaggctctaatataaatcagctggtgaagcggcacattcgctcagccaccgatctgcatattataggtatcgatcgcggcgagaggcaccttctctatctcacggtgattgattcaaggggaaacatcaaagagcagttctccttgaacgaaatcgtgaacgaatacaatggtaatacatataggacggattaccacgagctcctcgatacccgggagggtgagcgcactgaggcccggaggaactggcagaccatacagaacatcagggagcttaaagaaggctacctctctcaagttatacataaaatttctgagcttgctatcaagtataacgccgttattgtgctggaagacctgaacttcggatttatgcgctcccggcagaaagtcgagaagcaagtttaccagaagtttgaaaagatgctcatcgacaaactgaactatctcgtggacaaaaagaagcctgtcgcggaaactggaggactgctcagggcatatcagctcaccggagaatttgaatccttcaagacactgggcaagcagtccggaattctgttttacgttccagcctggaatacttcaaaaattgaccccgtcacaggatttgtcaacctctttgacactcattacgagaacattgaaaaggccaaggtgttcttcgataaatttaaatccattaggtacaactccgacaaagattggttcgaattcgtggtcgatgactacaccagattttcgccaaaggctgaaggcacaaggcgcgactggactatatgtacccaagggaaaaggattcagatttgccggaaccaccagcgcaacaatgaatgggagggacaggagatagacctgactaaggccttcaaagagcacttcgaggcgtatggcgtggatatctcgaaggatctcagggagcaaattaacacacagaacaagaaggagttttttgaggagctcctgaggctgttgagactcacattgcaaatgagaaactcaatgccgtcttcggacatcgactacctgatctcacctgttgcaaatgacactggttgcttttttgactctcgcaagcaggcggagttgaaggagaacgccgttctcccaatgaacgccgatgccaatggagcttacaacatcgcaagaaagggtttgctcgcgattaggaagatgaagcaggaggagaatgactccgccaagatctcgctggcgatcagcaataaggaatggcttaaattcgcgcaaacaaagccctacttggaagattga

SEQ ID NO: 189 - DNA, 3693 bp, Lachnospiraceae bacterium COE1
  Cpf1 (1)..(3693)
atgcatgagaataatggcaaaatcgctgacaatttcatcggcatctaccccgtgtctaagacgctgaggtttgagctgaagcccgtgggcaaaacccaggagtatatagagaagcatggcatcctcgatgaggatttgaaacgggcgggcgattacaagtcggtgaaaaagattattgatgcctatcataaatacttcattgacgaggctcttaatggtatccagctggatggactcaagaattattacgagttgtatgagaagaagagggataataacgaagagaaagagtttcagaagattcagatgagcctgcgcaagcagattgtcaaacgcttctccgaacacccgcagtacaagtacttgttcaagaaagagctgattaaaaacgtgctcccagagttcactaaagacaatgccgaggaacaaactcttgtgaagtccttccaggagttcacgacttactttgaggggtttcatcaaaaccgcaagaacatgtattccgacgaggagaaatctacggctatcgcatacagagttgtgcaccaaaatctccccaagtacatcgataatatgaggatattttcgatgattctcaatacagatatcaggagcgatttgacagagcttttcaataacctgaagactaagatggatataacaatcgtggaggagtactttgcaatcgatggatttaacaaagttgtgaaccaaaaaggaattgacgtctacaacactattctgggtgcgttttctaccgacgataatacaaaaataaaagggttgaacgagtatattaacctctataaccaaaagaataaggctaaactgccgaaactgaaaccacttttcaagcaaatcttgagcgatagagacaagatcagcttcatccctgagcagttcgattccgatacagaggtcctggaagcggtcgatatgttctataatcgcctcttgcagttcgttatcgagaatgaggggcagattaccatttcaaagttgcttaccaatttttccgcttacgaccttaacaagatttacgtcaaaaatgacactacaatctcggcgatatccaacgacctgtttgatgactggtcatacatctcgaaggctgttcgggaaaattacgactctgaaaatgtcgacaagaataaaagggcagcggcatatgaggaaaaaaaggaaaaagctctctccaaaattaagatgtacagcattgaagaacttaacttttttgtgaagaaatatagctgcaacgaatgccatatagaaggttatttcgaaagacgcatccttgagatactcgataagatgcggtacgcatatgagtcctgcaagatcctgcacgataaaggtctcataaacaacatctccctctgtcaggatcgccaggctattagcgaacttaaagactttctggattctatcaaagaggtgcagtggttgttgaagccgctgatgattggtcaagaacaggccgataaggaggaggcgttctacacggagctgttgcgcatatgggaggagctggaacctatcacgctcctgtacaacaaggttcgcaattacgtcacaaaaaaaccatacactttggagaaggttaagctcaatttctataagtctaccctcctggatggttgggacaagaacaaggagaaagataatctgggcatcatattgctgaaagatggccagtattaccttggcattatgaatcggaggaacaacaaaatagccgatgatgcccccttggctaagacagacaatgtctataggaagatggagtataagcttctcacaaaggtttctgctaacttgccgagaatattccttaaggataagtacaacccttctgaggagatgctcgagaaatatgagaaaggcacgcatttgaagggcgagaatttttgtattgatgattgtcgcgagctgatcgacttttttaaaaagggcataaagcagtacgaggattggggtcaatttgacttcaagttttccgacacggagagctatgacgatatatccgcgttttacaaagaggtcgaacaccagggttacaagatcacttttcgggacattgacgagacttacatcgacagcctcgtcaatgaaggaaaactgtacctgtttcagatttataataaggatttctctccttactcaaaaggtacaaaaaacctgcacacactttactgggagatgcttttttctcagcagaatctccagaacatagtgtataagctgaacggcaacgctgagatcttctatcggaaagcgtccatcaaccagaaagacgtcgtcgtgcataaggcggatcttcctatcaagaacaaggatccccaaaactccaaaaaggagtccatgttcgattatgatatcatcaaagacaagcggtttacatgcgacaagtaccaatttcacgtgcccataacgatgaatttcaaggcgctgggcgagaatcacttcaacaggaaggtcaaccggctgatccacgacgcggagaacatgcacattattgggatagataggggcgagaggaatctgatttacctctgcatgatagacatgaagggtaatattgttaagcaaatctccctcaacgaaatcatatcctatgacaaaaataaactggaacataagagaaactaccatcaactcttgaaaactagggaggacgagaataagtctgcacggcagtcctggcagactatacatacgataaaggagctgaaggagggttatctgtctcaagtcatacacgtgattactgatctgatggtcgagtataacgccatcgtcgtgctcgaagacctgaatttcgggtttaagcagggacgccagaagtttgagcggcaggtctaccaaaagttcgaaaagatgttgatagacaaacttaactatctggtggacaagtctaagggtatggatgaggatggtggattgctgcatgcctatcagctgactgacgagttcaagagcttcaagcaactgggaaaacagtcaggcttcctctactacatcccggcctggaacacatccaagctggaccctacgactggattcgtgaatttgttttatacaaagtatgagtccgttgaaaagtctaaagagttcatcaataacttcacttcgatactctataaccaagaacgcgaatactttgaattcctttttgactactccgcatttacgtctaaggcggagggtagcagacttaaatggaccgtctgttccaagggggaacgcgttgagacatatcggaacccgaagaagaataacgagtgggatactcagaagatcgatttgacttttgaacttaagaagcttttcaatgactattcaatttctctccttgacggcgatctcagggaacaaatgggcaagatagataaggcagacttttacaagaagttcatgaaactcttcgctctcattgtccagatgaggaactcagatgagagagaggataagctcatttccccagtgctcaataaatacggggccttcttcgagacaggcaagaatgagcggatgccgctggatgctgatgctaacggcgcatataatatcgcgcggaaggggctttggatcattgagaagataaagaatactgacgtggagcagttggacaaagtgaaattgaccatatcgaataaggaatggctgcagtatgcgcaagaacatatactctag

SEQ ID NO: 190 - DNA, 3621 bp, Butyrivibrio sp. NC3005
  Cpf1 (1)..(3621)
atgtactaccaaaatttgacgaaaaagtatcctgtctctaagaccatcaggaacgagttgatcccgatcggtaagacactggagaacatacggaagaacaacattctggagtccgacgtgaagaggaaacaggactacgaacacgtcaagggaatcatggacgagtaccacaagcagctgataaatgaagccttggacaattatatgttgccctccttgaatcaggcggcggagatatacttgaagaagcacgtggacgtcgaggaccgggaggagtttaagaagacccaggacttgctgagacgggaagtcaccggccggctcaaagaacatgagaactacaccaagatcggcaagaaagatatacttgatcttctggagaagcttccatccatatcggaagaggactacaacgcgctcgagtcattcaggaatttctacacatatttcacatcttacaacaaagtccgcgagaacttgtattcggacgaagagaagagctccactgtggcgtacagactcatcaacgaaaatctcccaaagtttctcgacaatataaaatcctatgccttcgtgaaggcggctggggttctcgcagattgcatcgaggaggaggagcaagacgccctcttcatggtggaaacgtttaacatgaccctgactcaggaaggcatcgacatgtataattaccagatcggaaaagtgaattccgcgatcaatctttacaaccaaaaaaatcataaggttgaggaattcaagaagattcccaaaatgaaggtgctctacaagcagatcctctccgatcgggaggaggtcttcatcggagagttcaaggatgacgagacactcctctcaagcataggtgcatatggtaacgttctcatgacgtatctgaagtcggaaaaaataaatatattcttcgacgcactgcgggagtctgagggcaaaaacgtgtatgttaagaatgacctcagcaaaacgacaatgtccaacattgtctttggctcgtggtccgccttcgacgagttgctcaaccaagagtacgaccttgccaatgagaacaagaagaaagatgacaagtacttcgagaagcgccagaaggagctcaaaaagaataagtcttacacactcgagcagatgtccaacctctcgaaagaagacatatcaccaatcgagaactacattgaaaggatctccgaagatatcgagaagatttgcatctataacggcgagtttgagaaaatcgtcgttaacgagcatgattcaagccgcaagctcagcaagaacatcaaggccgtcaaggtgatcaaggattacttggacagcatcaaggagctcgagcatgacattaagctgatcaacggaagcggacaagaacttgagaaaaatcttgttgtgtacgtgggacaggaggaggcgttggagcagctgcgcccagtcgacagcctgtacaacctgacaaggaactacctcacaaagaaacccttcagcacagagaaagtcaagttgaattttaacaagtctacacttctcaatggctgggataaaaacaaggagaccgacaacttgggaattctcttcttcaaagacgggaaatactacctggggattatgaatacaactgcgaacaaagcctttgtgaatccgcctgcggctaaaacggagaacgtcttcaagaaggtggattataagctgctccccggaagcaacaaaatgttgccaaaagtgttcttcgcaaagtccaacattggctattacaacccttcaacggagctctattctaattataagaaaggaacgcataagaagggaccttccttctctatcgacgactgtcacaatttgattgattttttcaaagagtcaatcaagaagcatgaagattggtctaagttcgggtttgaattcagcgacaccgccgactacagggatatctctgagttctatagggaggttgagaagcagggttacaaattgacattcactgatatagatgaatcatatataaatgatttgattgagaagaacgaattgtacctgtttcaaatttataataaagacttctcagagtatagcaaaggaaagctcaacctgcatacgctctatttcatgatgctctttgatcagaggaacctcgacaacgtcgtctacaagctcaatggcgaggccgaagttttttacaggcccgcatcgatagcggaaaacgagctggtgatacataaggccggggagggcataaagaacaaaaacccaaaccgcgccaaggttaaggaaaccagcaccttcagctatgatattgtgaaagacaagagatacagcaaatataagttcactcttcatatcccaataactatgaatttcggggttgacgaggtcaggcggttcaacgatgttataaacaacgcccttaggacggacgataacgttaacgttataggtatcgacagaggcgagaggaatctcttgtacgttgtggtgataaattctgagggcaagatcctggagcaaataagcctgaattctataataaataaggagtacgatatagaaactaactaccacgctctcctcgatgagcgggaggatgatcggaacaaagctcggaaggactggaacaccattgagaatattaaggagttgaagacgggttacctttcacaggttgtgaacgttgtcgccaaactggtcttgaaatacaacgctataatatgtcttgaggaccttaactttgggttcaagcggggccgccagaaggtcgagaagcaagtttaccaaaagtttgaaaagatgctcatcgagaagcttaattatctggttatagataagtcccgggagcaggtttcgccagaaaaaatggggggtgcactgaacgctcttcagcttacatctaagttcaaatctttcgccgaactcgggaagcagtccggaatcatatactatgttccagcatacttgacgagcaaaattgatcctaccacggggttcgttaaccttttttatatcaagtacgagaatattgagaaggccaagcagtttttcgacggttttgattttattaggttcaacaagaaggacgacatgtttgagttcagcttcgactataaatccttcactcaaaaggcctgcggaattaggtccaaatggattgtgtacactaatggtgaacggatcattaagtatcctaatcctgaaaagaacaacctgttcgatgaaaaggtgattaacgtcacagacgagattaagggcctgttcaagcaataccggatcccttacgaaaacggagaggacataaaagaaatcatcatcagcaaggcggaggctgacttctataagcggctgttcagactccttcatcagacactccaaatgagaaatagcacgtccgacggcacccgggattacattatctcacctgtgaagaatgatcggggggaattcttttgctcggagttttcggagggtacgatgccgaaggacgcagatgcaaacggcgcatacaacatagccaggaagggattgtgggtcctcgaacaaattaggcaaaaggatgagggcgaaaaagtcaatctttcaatgaccaacgccgaatggctcaaatacgctcaattgcacctgctctag

SEQ ID NO: 191 - DNA, 3465 bp, Proteocatella sphenisci
  Cpf1 (1)..(3465)
atggagaattttaagaatctctacccgataaacaagactcttaggtttgagctccgcccttacgggaagacccttgagaacttcaaaaagagcggacttctggagaaagatgcatttaaggcgaattcacggcgctcaatgcaggccattatcgatgaaaaattcaaagaaaccatcgaggaaagactcaagtacacggagttctcagaatgtgaccttggtaatatgacgagcaaggacaagaaaataacggataaagctgccacgaacttgaagaagcaggttatcctttcttttgacgacgagatattcaacaactatctcaaaccagacaagaacattgatgctttgtttaaaaacgatccgagcaacccagtcattagcacgtttaagggtttcacgacttattttgtcaatttctttgagatccgcaagcatatctttaaaggggagtcatcaggaagcatggcgtaccggattatcgatgagaacctgactacatacttgaataatatagagaaaatcaaaaagctccccgaagagctgaagtctcagctggaaggcatcgaccaaatcgacaaattgaacaattacaacgagtttattacgcaatcgggaataacccattacaatgaaattatcgggggaatatccaaaagcgaaaatgtcaaaatccaggggataaatgagggaatcaatctgtactgtcaaaagaataaagttaagctgccgcgcctcacccccctctacaagatgattctgtccgaccgggtctcgaattcatttgttctcgacacaattgagaacgatacagagttgattgagatgatttccgatctcattaacaagacggaaatttctcaagatgtgatcatgtctgatatacagaacattttcattaaatataaacagcttgggaacctgcctggtatttcgtattcctctattgtgaatgcgatatgctctgactacgacaacaatttcggcgacgggaaacgcaaaaaatcatacgagaacgacagaaagaagcacctcgaaaccaatgtgtatagcattaactacatctcagaactcctgactgataccgacgtgtctagcaatattaagatgagatacaaagaactggagcagaattatcaggtttgtaaggaaaacttcaacgccactaattggatgaatatcaagaatatcaagcaatcggaaaagacgaaccttatcaaggatctgctcgacatcctcaagtcgatccagcgcttctacgacctgttcgacattgtcgatgaggataagaatccctccgctgagttttacacgtggctgtcaaaaaacgccgaaaaactcgactttgagttcaactcggtgtacaacaaaagccggaattatttgactcgcaagcaatatagcgataagaagataaagttgaattttgacagcccgaccctggctaaaggatgggatgccaataaggaaatcgataactcgacaattatcatgcgcaagttcaacaatgataggggagattacgactattttctgggtatttggaataagtccacaccagccaacgagaagatcatccccctggaggacaacggcctgtttgagaagatgcagtataagttgtacccagacccatcgaagatgctgcctaagcagttcctttctaaaatctggaaggccaaacatcctaccacgcctgagttcgataagaaatacaaggagggcaggcataagaaaggcccggatttcgaaaaggaattccttcatgaactgatcgactgtttcaaacacggtctcgtgaaccacgatgaaaagtaccaggacgtttttggattcaatctcagaaacacggaggattataactcatatacagagttcctcgaggatgtcgagcgctgcaattataatctgtctttcaacaagatagcggatacaagcaatcttatcaacgacggaaagttgtatgtctttcagatatggagcaaggacttttctattgactccaagggcacaaagaatctcaataccatctatttcgaatccctgttctcagaggaaaatatgattgaaaaaatgttcaagctctccggcgaagccgagatattctacagacccgcgtcgcttaactattgtgaggacattattaaaaagggccatcatcatgcggagctgaaggacaagttcgattaccctatcataaaagataagaggtattcccaagacaagtttttcttccacgttccaatggtgataaactataagtcggaaaaactcaacagcaagtctctgaataaccgcaccaacgagaaccttgggcagttcacccacattattggaatcgaccggggcgagaggcacctcatatatctcacggttgtggatgtctcgacgggcgagatagtcgaacaaaagcatcttgacgagataataaacaccgacacgaagggcgtggagcataaaacccactatcttaacaagctcgaagaaaagagcaagacccgggacaacgaacggaagtcttgggaggctatcgaaacgatcaaagagcttaaggaaggctacatcagccatgtgattaacgagatccaaaagcttcaggaaaagtataatgccctgatagtgatggagaatcttaattacgggttcaagaattctaggattaaagttgaaaagcaggtgtaccaaaagtttgagacagctttgataaaaaaattcaattacataattgataaaaaagacccagaaacatatatccacggttatcaattgacaaatccgattactaccctcgacaagattggcaaccagtcagggatagtcttgtatattcccgcatggaatacatcaaaaattgatccggtcactggcttcgttaatctgctgtacgccgatgacctgaagtacaaaaaccaggaacaagccaagtcattcattcaaaagatcgacaacatctatttcgaaaatggggagtttaaattcgacattgacttcagcaagtggaacaatcgctactcaatttccaagaccaagtggactctgacatcctatggcactaggatacaaacattcagaaatccccaaaagaataacaagtgggactcagcagaatatgatttgacagaggaatttaagcttattttgaatatcgatggtactttgaagtcacaggacgtggaaacctacaaaaagtttatgagcctcttcaaactcatgttgcagcttaggaattcagttacggggacggacatcgattatatgatatcccccgttacagataaaactgggacgcattttgattccagggagaacatcaaaaacctgcctgcagatgctgatgctaatggggcatataacatcgcccgcaaaggtatcatggccatagaaaacattatgaacggcatctcggatcctcttaagatttctaatgaggactatctgaaatacatccaaaatcaacaggaatag

SEQ ID NO: 192 - DNA, 3696 bp, Butyrivibrio fibrisolvens
  Cpf1 (1)..(3696)
atgtactacgagagccttaccaagttgtaccccataaagaaaacgatcaggaatgagttggtccctattggcaagacgctggagaatattaagaagaataatattctcgaggccgatgaagaccggaagattgcctacattagggtcaaggctattatggatgactatcataagaggctgatcaatgaagcccttagcggctttgccctcatagacctggacaaagccgcgaacctgtatttgtctcggagcaagtccgcagacgatatcgaatccttttctagattccaagataaactccggaaggccatcgcgaagaggctgcgggagcacgagaattttggcaaaattggaaacaaagatatcatacccctgctgcagaagctgtcagagaacgaagacgactacaatgccttggaatccttcaagaatttttatacatattttgagtcatataacgacgttagactcaacctctactcagacaaagagaaaagcagcacagtcgcctatagacttattaatgagaatctcccgagattcctcgataatataagagcatacgatgcagtccagaaggcaggcatcacttccgaagagctgagctcggaggctcaggatggtcttttcttggttaataccttcaataatgtgctgattcaggatggtataaatacctataatgaggacattggcaagctcaacgtggccatcaatctttataatcagaagaatgcttccgtgcaaggctttcgcaaagtgccgaagatgaaggtgctttataaacagatattgtccgatagggaagagtctttcatagacgagttcgagtcagatacggagctgctcgactccctggagtcccactatgcgaaccttgcgaagtactttggttccaataaggtccaacttctcttcactgcactccgcgaatcaaagggggtcaacgtgtacgtgaagaacgatatcgccaagacctctttctcaaacgtcgtgttcggctcatggtcccgcatcgacgagttgatcaatggcgaatatgacgataataacaatagaaagaaggacgagaaatattacgataagcgccagaaggagcttaagaagaacaagtcctacactatagaaaagataatcacgctgtcgacggaggacgtggatgtgatcggcaagtacatagagaagctggagtcagatatagatgatatcaggtttaagggtaagaacttctatgaagcagtgctttgcggtcacgacagatctaagaagctctctaaaaacaaaggcgctgtggaagcgatcaaaggctaccttgattcggtcaaagacttcgagcgcgatctcaaattgatcaatggttctggccaggagctcgaaaagaaccttgtcgtttatggtgaacaggaggccgtgttgtcagaactttccgggatcgattcactctacaatatgaccagaaattacctgacaaagaagcccttctctacagaaaagataaaactgaattttaataagccgacctttcttgacggatgggattacggtaacgaggaggcatacctgggcttcttcatgattaaggagggaaactactttctcgcagttatggacgcaaactggaacaaggagttccgcaatatcccttccgtggacaaatctgactgctacaaaaaggttatatataagcaaatttcaagcccggaaaaatccattcagaacctcatggttattgatggtaagaccgtcaagaagaacgggcgcaaggaaaaagaaggtattcattcgggggaaaatctcatcctggaagaacttaagaatacctaccttcctaaaaaaatcaacgacattcggaagcggcgctcgtacctgaatggtgacactttttcaaaaaaggaccttacagagtttatcggttactataaacagcgcgtgatcgaatattataacgggtacagcttctatttcaagtcagacgatgactacgcatcttttaaagagttccaagaggacgttggcaggcaagcttaccagatttcgtacgtcgatgttccggtgtcgtttgtggacgatctgataaattctggtaaactgtatctcttcagagtgtataacaaggatttctctgaatattctaagggacggcttaacttgcatacgctgtactttaaaatgctgttcgacgagcgcaatttgaaaaatgtcgtgtataagctcaatggacaggccgaggttttctaccgcccttcatctatcaagaaggaagaactcattgttcatcgggcgggcgaggagatcaagaataagaaccccaagcgcgccgcacagaagccaactcggcggctcgactatgatatcgttaaagatagaagatattcgcaggataagtttatgcttcatacctccataataatgaactttggcgctgaggagaacgtctctttcaatgatattgttaatggggtcctgcgcaatgaggataaggtcaatgttattgggattgaccgcggcgagagaaatctgttgtacgtggtggtgatcgacccagagggaaagattctcgagcagaggtcactcaattgtattactgattccaatcttgacatagagactgactatcaccgcctcttggatgagaaggagtctgaccgcaaaatcgcgagacgggactggactactatagagaacatcaaagaactcaaggccggctacctttctcaagtcgttcacatcgtcgcggagttggttcttaagtacaacgcaattatttgcctggaggacctgaattttggctttaagaggggaaggcagaaagttgaaaagcaagtttatcaaaagttcgagaaaatgcttatagacaagctgaattacctcgttatggacaagtcgcgggaacaattgagccctgagaaaatttccggcgcccttaacgctctccagctcacaccagatttcaagtcattcaaggtcctcggcaaacagacgggtatcatctactacgtgcccgcctacctcacttccaagatcgatccgatgacagggttcgccaaccttttctacgtcaagtatgagaatgtcgacaaggctaaggagttcttttccaagtttgatagcataaagtataataaagatgggaaaaattggaacaccaagggctactttgagtttgctttcgattacaaaaagtttacggacagggcttatggtagagtctcagagtggactgtgtgcacagtcggcgagaggattatcaaattcaagaacaaggagaagaataattcttacgacgacaaggtgattgatttgaccaactctcttaaggagttgttcgactcttataaggttacatacgagagcgaggtcgacctgaaggatgcgatcctcgctatcgacgacccagctttctatagggacttgacgagaaggcttcagcagaccctgcagatgagaaattcctcttgtgatggcagcagggattacattatatccccggttaagaactcaaaaggagagtttttctgctccgataacaatgatgatacgactccgaatgacgccgatgcgaatggggcctttaatatcgcgcggaaaggtctttgggtgctgaatgaaatacggaactctgaagaaggctctaagatcaatctcgcgatgtctaatgctcaatggctcgagtatgcccaggacaacacaatatga

SEQ ID NO: 193 - DNA, 3174 bp, Microgenomates (Roizmanbacteria) bacterium GW2011_GWA2_37_7
  Csm1 (1)..(3174)
atggagatacaggagcttaagaacctgtacgaggtcaagaaaacagtgaggttcgagctcaagccctcgaaaaaaaaaatattcgagggtggggacgtcattaagctccagaaggactttgagaaggtccagaagttcttcctggacatcttcgtctacaagaatgagcacacaaagctggagtttaaaaagaagcgcgaaatcaaatacacctggttgagaacaaacacgaagaacgagttctacaattggagggggaagagcgataccgggaagaactacgccctgaataagattggattcctcgccgaagagatactcaggtggctgaacgagtggcaggagctcactaagtcactgaaggacctcacacaaagggaggagcataagcaggagaggaagagcgatatcgcgttcgtgcttaggaattttctgaaaaggcagaacctcccatttataaaggacttcttcaatgctgtgattgatatccaagggaagcaagggaaagaatctgatgacaagataagaaagttccgggaagaaatcaaggagatcgagaaaaatcttaacgcgtgtagccgcgagtatctccctacccagagcaacggtgttttgttgtataaggcgtcgttttcgtactatacgcttaacaaaactccgaaagaatacgaagacctgaagaaggagaaggaaagcgaattgtcttccgtgcttctgaaggagatctatcgcaggaagcgcttcaatcggaccaccaaccaaaaagatacactctttgaatgtacctctgactggctggtgaaaatcaaactggggaaggatatctacgagtggacccttgacgaggcttatcagaagatgaagatatggaaagccaaccagaaatcgaattttattgaagccgtcgccggcgataagttgactcaccaaaactttcggaagcaattccctctgttcgatgcttccgatgaagactttgagaccttctacaggcttaccaaggcccttgacaagaatcctgaaaacgcgaaaaagatcgcccagaagcgcgggaaatttttcaatgcaccaaatgagactgttcaaactaagaactatcatgagttgtgcgagctgtataagcggatcgcagtgaagagaggcaagattattgccgagataaagggcatcgagaacgaagaagtgcagtcacagcttttgacccattgggctgttatcgcggaagagcgggacaagaagtttatcgtgcttattccacgcaagaacggaggcaagctggagaatcataaaaatgcccacgctttcctgcaagaaaaggataggaaagagccgaacgatattaaggtgtaccattttaaatctctcacgctgcgctctctggagaagctttgtttcaaggaggccaaaaataccttcgcccctgaaataaagaaagaaacgaaccctaagatctggttccctacgtacaaacaggaatggaattcgactccggaaagattgataaaattttacaagcaggtcttgcaatccaactatgctcagacttacctggatctcgttgatttcggcaacctgaatacctttctggagactcatttcaccacactcgaggagttcgagtctgaccttgaaaagacgtgttatacgaaagtgcctgtgtactttgcgaagaaggaacttgagacctttgctgatgagtttgaggccgaagtgtttgagattacgaccagatcgatctcgaccgagtcgaagaggaaagaaaatgcccacgctgagatctggagagatttttggtcacgcgagaacgaagaagagaatcatatcacccgcttgaatcccgaagtctctgtcctctatagggatgagataaaagaaaaatccaacacctcgcggaaaaatcgcaagtccaatgctaacaaccgcttcagcgacccaagatttacgcttgcgaccacgataacactgaacgctgacaagaagaagtccaatcttgccttcaaaacagtcgaggatataaatatccacatagacaacttcaataagaaattttctaagaacttttccggcgagtgggtctacggtatcgatcggggtctcaaggagctggcaacattgaacgtcgtgaagtttagcgatgtgaaaaacgtgttcggcgtgtctcagcctaaggagtttgctaagatccctatctacaagttgagggacgagaaggctatcctgaaggatgaaaacggcctgagcctgaagaatgctaagggggaggctaggaaagtgattgacaatattagcgacgtgctcgaggaggggaaagaacccgacagcacactctttgaaaaacgggaagtgagctccattgaccttactagagcgaagctgataaagggacacattatcagcaacggtgaccagaaaacctatttgaaattgaaggaaacctccgccaagagaagaatcttcgaactgttttccactgcgaagattgacaaatcttctcagttccatgttcggaaaacgatagaactgtctggtacgaagatttactggctctgtgagtggcagcggcaagactcctggcgcacagagaaggtctctcttcgcaacacgctcaagggatacctccagaatttggatctgaagaatcgcttcgaaaatatcgagaccatcgaaaaaattaatcatctgcgcgatgctatcacagcaaacatggtcggtattttgtcacatctccagaacaaactcgaaatgcagggagttatagcactggagaacctggataccgtccgggagcagtccaacaagaagatgattgatgaacacttcgaacagtcaaacgagcacgttagcaggcgcctggagtgggcgttgtactgcaagttcgcgaacactggtgaagttccacctcagattaaggagagcatcttcctgcgggatgagttcaaagtttgtcagattggtattttgaatttcatcgacgtgaagggtacctcgagcaactgccccaactgcgatcaggagtctaggaaaaccggatcacatttcatttgcaatttccagaacaattgcatatttagctccaaggaaaaccggaacctcctcgaacaaaatctgcacaattcagacgacgtcgctgcttttaacattgcgaagcgggggttggaaatagttaaggtctag

SEQ ID NO: 194 - DNA, 3669 bp, Oribacterium sp. NK2B42
  Cpf1 (1)..(3669)
atggagaccgagatcttgaagtatgatttcttcgagagagagggcaagtatatgtattatgacggcctcaccaagcagtacgcactgtcaaagacgattaggaatgaacttgttccaatcggcaagaccctggacaatattaagaagaatcggatcctggaagccgacattaaaaggaaaagcgactatgaacacgtcaaaaaactcatggacatgtaccacaaaaagatcatcaacgaagcgctcgataatttcaaactttcggtgttggaagatgcagcagacatttactttaacaagcagaacgacgaaagggatattgacgcttttttgaagatacaggataaactccgcaaggagatagtcgaacagttgaaggggcacaccgactattctaaagttggaaacaaggattttcttggtctcctcaaggctgcttccacagaagaggatagaatactcatagaatccttcgataacttctacacatattttacatcctacaataaagtcaggagcaacctctactccgcggaagataagagctccactgtggcttataggctgattaacgagaatctccccaaattcttcgacaacatcaaggcttatagaactgtgcgcaacgctggagttatatctggtgatatgtctatagtggagcaggacgagcttttcgaggtcgacacgttcaatcacaccctcactcagtacggcattgacacttacaaccatatgattggtcagctcaattccgctattaacctctataaccagaaaatgcacggtgccggttcattcaaaaagcttccaaagatgaaggagctgtacaagcagcttctgaccgagcgcgaggaggagttcatcgaggagtacaccgacgatgaagtgctgatcaccagcgtgcacaactacgtctcatacttgatcgactatctcaactcggataaggtggaatccttcttcgacacattgagaaagtccgacggcaaggaggtcttcattaagaatgacgtgagcaagacaacaatgtccaacatactctttgacaattggtcaactatcgacgacctgatcaaccacgagtacgactcggcgcccgagaacgtcaagaaaactaaggatgataagtacttcgagaaaaggcaaaaggacctgaagaagaacaagtcatactccttgagcaaaatcgccgctttgtgccgcgataccaccatcctggagaaatacatcagacgccttgtcgacgatatagaaaagatatacacctctaataacgtttttagcgatattgtgctgagcaagcacgaccgcagcaagaaactgtcaaagaatactaacgcggttcaggcgattaagaatatgctggactcaataaaagatttcgagcacgatgtgatgctgataaatggctcggggcaggagattaagaaaaacctgaatgtttactctgaacaggaagcgctcgcaggtattctcagacaggtggaccatatctataaccttactcgcaattaccttacaaagaagcctttcagcaccgagaaaatcaaactcaacttcaacaggccaacatttctggatggatgggacaaaaacaaggaggaagctaaccttggtatcctcttgattaaagataacaggtactatttgggcatcatgaacacgtcaagcaacaaagctttcgtgaacccgccaaaggcaatctccaacgatatttataagaaagtggattataagctcctcccgggcccaaacaagatgttgcccaaagtgttctttgcaactaagaacattgcttattatgcgccatcggaagaacttttgagcaaataccggaagggcactcataaaaaaggcgatagcttctcaatcgatgattgcagaaacttgatcgactttttcaagtcttccattaataagaacactgactggtccacattcggtttcaatttctctgatacaaattcctacaacgacattagcgatttctaccgcgaagtggaaaagcagggctacaagctctcattcaccgatattgatgcgtgttatatcaaggacctcgtcgataataatgagctttacttgttccagatttacaataaggacttctcaccatactccaagggtaagctcaatctgcataccctttactttaaaatgcttttcgatcagaggaatttggacaacgtcgtctataagctcaacggggaagctgaagtcttttataggccagcctcgatcgagtcggatgagcaaatcatccataaatctggccagaacattaagaacaaaaaccagaagagaagcaactgcaaaaaaacatctaccttcgactacgacatcgtgaaggatagaagatactgtaaagacaagttcatgcttcacttgcccataacagtgaatttcggaaccaacgaatcagggaagttcaacgagttggtcaacaacgccatccgcgcagataaagacgtgaacgtgattggtattgacagaggcgagaggaaccttctttatgtggtggtcgtggacccctgcgggaagataatcgagcaaatctcactgaacactatcgtcgataaagagtatgacattgagacggactaccatcagctgttggatgagaaggaaggcagcagggataaggcaagaaaggattggaataccatcgaaaatataaaggagctcaaagagggctacctctctcaagtcgtcaatataatcgcaaagctggtgctcaagtacgacgctattatctgcttggaggatttgaacttcgggttcaagcggggccgccagaaagtcgaaaagcaggtttaccagaagttcgaaaagatgctcattgataagatgaattacctggtcttggacaagagcagaaagcaagagtctccacaaaaaccgggcggtgctctcaatgcgctgcagttgacctctgcgttcaagtctttcaaggagttgggtaagcagactggcataatttactacgtgccggcatacctcacaagcaaaattgaccccacaaccggcttcgcgaacctgttttacataaagtacgagtcagtcgataaggcgcgcgatttcttctcaaagtttgacttcatccgctacaatcagatggataattatttcgagttcgggttcgactataagtctttcactgaacgcgcatctggctgcaagtccaagtggattgcgtgcacaaatggcgagaggattgtcaagtaccgcaactccgacaagaataactcatttgatgacaagacggtgatcctgaccgatgaatatcggtcgttgtttgataagtaccttcagaactatatcgatgaggacgatttgaaagaccagatcctccagatcgacagcgcggacttctataagaacctgatcaaattgttccagttgacgttgcagatgcggaactcgagctccgacggcaagagagattacattatctcccctgtcaagaactatagagaggagtttttttgttctgagttctctgatgatacgttcccgcgcgatgccgatgccaatggagcttataatatagcgaggaaggggctgtgggtcattaagcagattagagaaactaagtccggtaccaagatcaacctggcgatgagcaactcggagtggctcgaatacgcccaatgtaacctgttgtaa

SEQ ID NO: 195 - DNA, 3780 bp, Synergistes jonesii strain 78-1
  Cpf1 (1)..(3780)
atggcgaacagccttaaagattttaccaacatctaccaactctcgaagactcttagattcgaattgaaacccattggcaagaccgaggaacatataaataggaagctgataatcatgcatgatgaaaagcggggggaggattataaatctgtgaccaaactgatcgacgactaccacaggaaattcatccacgagaccttggatccagcccattttgattggaacccgctcgctgaggcgcttatccaatcgggctcaaaaaataataaagcgctccccgcggagcagaaggagatgcgggagaagatcatttctatgttcacttcgcaggcggtttataaaaaactgtttaaaaaagaactcttctctgagttgctgccagagatgatcaagagcgagctggtgtcagatttggaaaagcaagcccaactcgacgccgtgaaatcattcgataagttttcgacctacttcaccggattccatgaaaataggaagaacatatatagcaagaaggacaccagcacctcaattgccttccgcatcgttcatcaaaacttcccgaaatttctcgcaaatgtgcgggcttatacattgataaaagagcgggctcctgaagtcattgataaagcccaaaaggaactgtccggcatcctcgggggaaaaaccctcgatgatatattttcaattgagtcttttaacaacgtcctgacccaagataagattgattattacaatcagatcattggcggcgtcagcggaaaagctggtgacaagaagctcagaggtgtcaatgagttctctaatctgtacaggcaacagcaccccgaggttgcctccctgcggatcaagatggtgccactgtacaaacagatactttccgatagaacaacgctttctttcgtgccggaagctttgaaggacgacgaacaagcgattaatgccgtggacggtctgaggtctgagctggaacgcaacgatatctttaataggataaagcggctctttgggaagaataacctctactcgcttgataagatctggatcaagaacagctccatctctgcattctccaacgagcttttcaagaattggagcttcattgaggacgccctcaaggaatttaaggagaacgaattcaatggcgccaggtccgccggcaagaaagccgaaaagtggctcaaatccaaatatttctcttttgcagatatcgacgcagccgtcaaaagctacagcgaacaggtctctgccgatatctcgtctgcgccgtctgcttcctactttgccaaattcacaaacttgatcgagaccgcggctgagaacggacggaaattctcatatttcgctgcggagtcaaaggccttcaggggagatgacggaaaaacagagatcattaaggcgtatctcgactcacttaacgatatccttcactgtctcaagccatttgagaccgaggatatatcggatatcgataccgagttctactcggcttttgccgagatatacgactcggtcaaggatgttatacccgtctacaatgctgtgagaaattacacaactcaaaagcccttctccacagagaagttcaaacttaattttgaaaaccccgcactggcgaagggctgggacaagaacaaggaacaaaataacacagcaatcatccttatgaaagacgggaaatattacctgggcgttattgacaaaaacaataagctgagggccgatgatcttgccgatgatggctctgcctacggctacatgaagatgaactataagttcatacctacgccccatatggagctgccaaaggtcttccttcctaaacgggcccctaagcggtataacccctcacgggagatcttgctcatcaaggagaataagacctttatcaaggataaaaacttcaacaggacggactgccataagctgatcgactttttcaaagattcgattaataaacacaaggactggaggactttcgggttcgatttttcagatacggactcatacgaggatatttcagatttctatatggaggttcaggatcagggctacaagcttacattcacccgccttagcgcggaaaaaatcgataagtgggttgaagaaggccggctttttctgttccaaatttacaacaaagatttcgccgacggagcacagggctccccgaatctccacacactctattggaaggccattttctccgaggagaacctcaaagatgtcgtgctgaagttgaatggcgaggccgagctcttcttccgccgcaagagcattgacaagccggcagtccatgcgaagggatccatgaaagtgaatcgcagggacatagacggaaacccaatcgacgagggtacctacgtggagatctgtggctacgccaacggaaaacgggacatggcgtcgctcaacgcgggagcgagagggctcattgagtctggcctggtccgcataacggaagtcaaacacgaactggtcaaggataagcggtacactatcgacaagtatttcttccacgtcccgttcactatcaacttcaaggcacagggacagggcaacattaactccgacgtcaatctcttccttaggaataataaggacgttaacatcattggcatcgacaggggggagcgcaacctcgtgtacgtgtcgctgatagatagagacggacacatcaaattgcagaaggacttcaatattattggtggtatggactaccatgccaaactgaaccagaaggaaaaagagagagatacagcccgcaagtcctggaaaacgattggtaccattaaggagctcaaggagggttacttgtcacaagtcgttcacgagatcgtcagactcgctgtcgataataatgctgtgattgtcatggaagatcttaacataggttttaagaggggcagattcaaggttgagaaacaggtgtatcagaagttcgaaaaaatgcttatcgataaattgaactacctggtgttcaaagatgcgggctatgatgccccctgtgggatcctgaagggccttcagctcacggaaaagttcgaaagcttcactaagttgggcaaacaatgcggcatcatattttatatcccagcgggttacacgagcaagatagatccaacaaccgggtttgtgaacctcttcaacatcaacgacgtgtcaagcaaggagaaacaaaaggatttcattggtaaactcgactctatccggttcgatgctaagagggatatgttcaccttcgagtttgattacgataagttcaggacctaccagacgtcgtaccggaagaaatgggccgtgtggactaatggcaaacgcatcgtcagggaaaaagataaggatggcaagtttcggatgaacgaccgccttctcacagaagatatgaaaaacattttgaataagtacgctctggcatacaaggcgggggaagatatactcccagatgtgatcagcagggataagagccttgcctccgaaatattctacgtgttcaaaaacaccctgcaaatgcgcaattctaagcgcgacaccggtgaagatttcataatttctccagtcctgaatgcgaaaggcagattcttcgactcgcggaaaacagatgccgcgctcccgatcgacgccgatgcaaacggtgcgtatcatatcgcgctcaagggctctttggtcctcgatgctatcgatgaaaagctgaaggaggacgggagaatagattacaaagacatggccgtgtcgaacccgaagtggtttgagtttatgcagactagaaagtttgatttctga

SEQ ID NO: 196 - DNA, 3822 bp, Flavobacterium sp. 316
  Cpf1 (1)..(3822)
atgaagaatttctcgaacctctaccaggtgtctaagacagttcgcttcgaactgaagcccatagggaatacactggagaatattaaaaacaaaagcctcttgaagaatgactcgattagggcggagtcatatcagaaaatgaagaagacgatagacgagttccataagtacttcatcgaccttgccttgaataacaaaaagctctcgtatttgaacgagtacattgccctctacactcaaagcgcagaggctaaaaaggaggataagtttaaggccgactttaagaaggttcaggataacctcagaaaggagattgtgtcttccttcactgagggcgaagcgaaggcaatcttctcagtcctcgataagaaagaattgataacgatcgagctcgaaaagtggaaaaacgagaacaacttggcagtctatctcgatgagtcatttaagagcttcactacatactttacgggttttcaccagaatcgcaaaaatatgtactcggccgaggcgaatagcactgcgattgcctaccgcttgattcacgagaatctgccgaagttcattgagaattccaaagccttcgagaagagctcacaaatagctgagcttcagccaaagatcgaaaagctgtataaggagtttgaagcctacctcaatgtgaattctatctcagagctttttgagattgactattttaacgaagttctcacccaaaagggcataactgtgtacaacaacataattggaggcaggacagcaaccgagggcaaacagaagattcaaggcttgaatgaaataataaacctctataatcagaccaagccgaagaacgagaggttgcctaaacttaagcagttgtacaagcagatactttcggataggatctccctctcgttccttccggatgccttcacagaaggtaaacaggtgctgaaagccgtttttgagttttacaagattaatctcctctcctataaacaggatggcgttgaggagtcccaaaacttgctcgagcttatccaacaggtggtgaaaaatctcgggaatcaggatgttaataagatctacctgaagaacgacacaagccttactacaattgcccaacagctgttcggcgatttctcagtgttctccgccgccctgcaataccggtacgaaacggttgtgaatcctaagtatacggctgaatatcaaaaagccaatgaggccaaacaggagaagctcgacaaggagaagattaagttcgtcaaacaggattacttcagcattgcatttctccaggaagtggttgctgactatgttaagactttggacgagaacctggattggaaacagaagtacacacccagctgcattgccgattacttcacaacacactttattgcgaagaaagagaatgaagcggacaagacttttaattttatcgcaaacattaaagcgaaataccagtgtatccagggcattctggagcaagctgatgattacgaagatgagcttaagcaagaccagaaactgattgataacattaaatttttcctcgacgctatactggaggtggttcatttcataaaaccgctgcatctcaagagcgagtccataacagagaaggacaacgcattttatgacgtcttcgagaattactacgaagcgctcaatgtcgttacaccactctacaacatggtgcggaattatgtcactcagaaaccttattccacagagaagatcaagcttaactttgaaaatgcacagctgctcaatggttgggatgccaataaagagaaggactacttgacaacaatcctgaagcgggatggtaactactttttggctattatggataaaaaacataataaaacatttcagcaatttacagaggacgacgagaactacgaaaagattgtttacaagttgcttccgggcgtcaacaagatgctgcctaaggtgttctttagcaataagaacatagcattctttaatccaagcaaagagatcttggataactacaaaaacaacacacataagaagggggcaacgttcaatctcaaggactgccatgcgttgatcgatttcttcaaggattcactcaataagcatgaagactggaagtactttgacttccagttctccgagacgaagacctaccaggatctgtctggtttttataaagaggttgagcaccaaggctataagataaactttaagaaagtgtctgtctcccaaatcgacacccttatagaagagggcaagatgtaccttttccagatctataataaggatttctctccatacgcaaagggcaagcctaacatgcacactctgtactggaaagcgttgttcgagacgcaaaatctggaaaacgttatctacaaactgaacggccaggctgagatctttttcaggaaggcgtcaattaagaagaagaacattattacacacaaggcgcatcagcccattgcagccaagaaccctctgacaccaaccgcgaaaaacaccttcgcgtatgaccttattaaagacaagaggtataccgtcgacaagtttcaattccatgtcccgataacaatgaattttaaggctactggcaattcttacatcaaccaagatgttcttgcatatcttaaggataatcccgaagttaatatcattggccttgaccgcggtgaaaggcacctcgtgtatttgacgcttattgatcaaaaaggaacgattctcctgcaggagtcactcaacgtcattcaggacgagaagacacacaccccttatcacactcttttggacaacaaggagatcgctagggataaggcgaggaagaactggggatctatagaatctatcaaagagctgaaggagggttatatttcacaagtggttcacaagattacgaagatgatgattgagcataatgccattgttgtgatggaggatctgaacttcggtttcaaaagggggcgctttaaggtggaaaagcagatctaccagaagctggaaaagatgctgatcgataagcttaattacctggtgctgaaggacaaacagccacatgagctggggggactgtataacgcgctccaacttaccaataagttcgaatcgttccaaaaaatgggaaagcagtctgggtttctgttctatgttcctgcatggaacacatcgaaaatcgatcccacaaccggctttgtgaactacttctacacaaaatacgagaatgttgagaaggccaaaactttcttcagcaaattcgactcgattctttacaacaaaaccaaaggctatttcgaatttgtcgtcaagaactacagcgacttcaatccgaaggcggcggacactcggcaagagtggaccatctgcacccacggcgaacgcatcgaaaccaagaggcaaaaggaacagaacaataatttcgtgtctacgacaattcagcttacagaacagttcgtgaacttcttcgaaaaggtgggcttggacctttccaaggagcttaaaactcagctgatagctcagaatgaaaagtctttctttgaagagctctttcatctgctgaagttgactctccaaatgcgcaatagcgaatcacataccgagattgattatcttatatccccggtcgctaatgaaaaggggatattttacgatagccggaaggccacggcctccctgcccatcgatgcggatgcgaacggggcctatcatattgcgaaaaaggggctgtggattatggaacagattaataaaacaaactcggaagatgatttgaagaaagtcaagttggcgatttcgaaccgcgagtggctgcagtacgtgcagcaggttcagaaaaagtga

SEQ ID NO: 197 - DNA, 3996 bp, Parcubacteria bacterium GW2011
  Cpf1 (1)..(3996)
atgaagccagtgggaaaaacggaggacttcctcaaaattaacaaagtctttgagaaggaccagacaatagatgatagctataaccaggctaagttctactttgatagccttcatcagaagtttatcgatgccgcgctggcgtccgataaaacttcggaactgtcttttcagaatttcgcggatgttctcgagaagcagaataaaatcatcctggataaaaaacgcgaaatgggggctctcaggaagcgggataaaaacgccgtggggatcgacaggcttcaaaaggagattaacgacgccgaagatattattcaaaaagagaaggaaaaaatatacaaggatgtgaggactctgtttgacaacgaggccgagtcgtggaagacatactatcaggaaagagaagttgacggcaagaagatcacgttctccaaggctgacttgaagcagaaaggcgccgattttctcacagctgctggaattctgaaggttctcaagtacgaatttccagaagaaaaggaaaaggagtttcaagcaaaaaaccaacccagcctcttcgttgaagaaaaggagaaccccggccagaagagatacatctttgactctttcgataagttcgccggctacctgacaaagttccagcagactaagaaaaacctttacgcggccgatggcacatcgaccgcagtcgcgacccggattgctgataacttcataattttccaccaaaatactaaggtgtttagggacaagtacaagaacaaccacaccgacctgggcttcgacgaagagaacatcttcgaaatagagcgctataagaactgcctcttgcaaagagaaatcgagcacattaagaacgagaattcctataacaagataatcggaagaatcaacaaaaagattaaagaatacagggaccaaaaggcaaaagatacaaagctgacaaaatccgacttccctttctttaagaacttggacaagcagatcctcggggaggttgaaaaagaaaaacagctgattgaaaaaacacgggagaagactgaggaggacgtccttatcgagagattcaaggaattcatcgagaataatgaggagagatttaccgcggccaagaagcttatgaatgccttctgcaacggagagtttgagtccgagtacgagggcatatatctgaagaacaaagcgattaacaccatctcgaggcgctggttcgtttctgatagagacttcgagctcaaactgccgcagcagaagtccaagaacaagagcgagaagaatgagccaaaggtgaaaaagtttattagcattgcggaaatcaagaacgccgtcgaggagttggatggcgacatctttaaggcggttttctatgataagaagataattgcgcaaggcggctcgaagttggaacagttcctggtcatctggaagtacgagtttgagtacctgttccgcgacatcgaacgggagaatggcgagaagctccttggctacgactcatgtttgaaaattgctaaacaacttggcattttcccgcaggagaaggaagcgcgcgaaaaggcaactgcggtcataaagaattatgctgatgcaggtctcggtatcttccagatgatgaaatatttttcactcgatgataaggacagaaaaaacacgcccggccaacttagcacgaacttttatgccgagtacgatgggtactacaaggacttcgagtttatcaaatactacaatgaattcagaaacttcattacaaaaaagcctttcgacgaagacaagatcaagctcaatttcgagaacggtgcgcttctcaagggctgggatgagaacaaagagtacgatttcatgggtgtcattctgaagaaggaagggcggctgtatctcggtatcatgcacaaaaatcacaggaagcttttccagtctatggggaacgctaagggggataatgctaaccggtatcagaaaatgatctacaaacagatcgctgacgccagcaaggatgtgccgcgcctgttgctgacatctaaaaaggccatggaaaagttcaagccttcccaagagatcctcagaattaaaaaggaaaaaaccttcaagagagaatctaagaacttcagcctccgggatctgcacgcacttatcgagtactacaggaactgcataccgcaatactctaattggagcttctatgactttcagtttcaggacactggaaagtatcaaaatatcaaagagttcacggacgacgtgcaaaaatacggctacaaaattagcttccgggacattgacgatgagtatatcaaccaagcgctcaacgagggaaagatgtacctgttcgaggtcgttaataaggatatctacaataccaagaatggatctaaaaacctgcacactctttacttcgagcacatactttcagctgagaatctgaacgaccccgtcttcaaactgtcgggcatggccgagatttttcaacggcaaccctcggtcaacgagagggagaaaatcacgacccagaagaaccaatgcatcttggataaaggcgaccgcgcatataagtatcgccgctacaccgagaaaaagataatgttccatatgtccctcgtgcttaacactgggaaaggcgaaattaagcaggtccaatttaacaaaattatcaaccagcggatcagctcttcagataatgagatgagggtcaacgtgataggtatcgaccgcggcgagaaaaatcttctctattattctgtggtcaagcagaacggagaaataattgagcaagcgtcactcaacgaaataaacggcgtcaattatagggacaagctgattgagcgcgaaaaggaaaggctcaaaaataggcaatcctggaaaccggtggtcaagatcaaggacctgaaaaagggatacatcagccacgtcattcataaaatatgccagttgatcgaaaagtactctgccatcgtcgtgctcgaggatcttaacatgaggttcaaacaaatccgggggggaatcgagcgctcagtctaccaacagttcgagaaggcactgatcgacaagctcggctaccttgttttcaaggataacagagacctgcgcgcgccggggggcgtgctgaacggatatcagctttcagccccgttcgtttcctttgaaaagatgcgcaagcagactggtatcctgttctatacgcaagccgagtatacatcaaagactgatccaattactggcttcagaaaaaacgtctatatctccaattctgcgtcgcttgataagattaaggaggcggttaagaaattcgatgccattggctgggatggaaaggagcaatcatacttttttaaatacaatccatacaacctcgccgatgagaaatataaaaattcgactgtttcgaaggagtgggccatatttgcctcagccccgcgcatcaggaggcagaaaggagaagatgggtactggaaatacgaccgcgtcaaggtcaacgaagagttcgaaaagctgttgaaagtctggaacttcgtcaaccctaaggctacagatattaagcaagagataatcaaaaaagagaaggccggcgatttgcagggcgagaaagagctcgatggtcgcctccgcaatttctggcactcctttatatacttgttcaacctcgtccttgaactccgcaactctttctccctgcagatcaagattaaggccggggaagttatcgcggtcgatgagggtgtggatttcatagcatccccagtcaaaccgtttttcaccacaccaaacccttacataccgtctaacttgtgctggcttgcggtggaaaatgcggacgcgaatggtgcttataacatcgccaggaagggcgtgatgattctcaagaagataagagagcatgctaaaaaagaccctgagttcaagaagcttccaaatctgtttatttcgaacgccgaatgggacgaagcggcacgggattggggtaaatacgccggcactacggctctcaatctggaccactag

SEQ ID NO: 198 - DNA, 3762 bp, Prevotella albensis
  Cpf1 (1)..(3762)
atgaatattaaaaatttcacagggttgtatccgctctctaagacgttgcgcttcgaattgaagccgatcgggaagacaaaggagaacatagaaaaaaacggaattcttaccaaggatgagcaaagggcaaaggattacctgatagtgaaggggtttattgacgagtaccacaaacagttcatcaaagatagattgtgggacttcaagctcccattggagagcgaaggcgagaaaaactctctcgaggagtaccaggaactctacgagctcaccaagcggaatgacgcccaggaggctgactttacagaaatcaaagacaacctcaggtcctcaatcacagagcagctcacaaaaagcggatctgcatacgaccggatattcaagaaagagtttatccgggaagatttggtgaacttcttggaagatgagaaggataagaacattgttaaacagtttgaagactttacgacctactttactgggttttacgaaaataggaagaatatgtacagctctgaggagaaatctacggcgattgcttacaggttgatccatcagaaccttccgaagtttatggataatatgcgcagctttgcaaagatagcgaactccagcgtgtcggagcatttttcggatatatacgaatcttggaaggagtacctcaatgtcaattcaatcgaggagatttttcagctggactattttagcgagaccttgacgcagcctcatatcgaggtctacaattacatcatcggcaagaaagtcctggaagatgggactgagataaaaggaatcaacgagtacgtgaatctgtacaaccagcaacagaaggataagtcaaagaggcttcctttcctggtgccactttataagcagatcttgtccgacagagagaagctctcctggatcgccgaggaattcgactcagacaagaaaatgcttagcgccatcaccgagtcctataaccatcttcacaatgttctcatgggtaacgagaatgaaagccttcggaaccttctcctgaatataaaggattataatctggagaaaattaacataactaacgatcttagccttactgaaatttcacagaacctcttcgggagatacgacgttttcaccaacggcatcaagaataaactgcgcgtgcttactccacggaagaagaaggagactgatgaaaatttcgaagatcgcatcaacaagatctttaaaactcagaaatctttttcgatcgccttccttaacaagcttccacaacccgaaatggaagacgggaagccacgcaatatagaagattacttcataacccagggcgcaatcaataccaaatcgattcagaaggaggatattttcgcgcaaattgagaacgcgtacgaagacgcacaggtctttcttcagattaaggacactgacaacaaactgtcccagaataagacagcagtcgagaaaataaagacactgctggacgcgctcaaggaactgcaacatttcataaagccgctgctgggttcaggggaggagaatgagaaagacgagcttttttacgggtcgttcttggcgatctgggacgagctcgacaccatcacacccctctacaacaaggtgcggaactggctcaccaggaaaccatattcaactgagaaaataaagctgaacttcgataatgctcagctgctgggcggctgggacgtcaataaagagcatgactgcgcgggaatcttgctgcgcaaaaacgattcatactacctgggtatcatcaataaaaagaccaatcacattttcgacacggacatcacaccttcggatggtgagtgctacgataagatcgactacaaactcctgcctggagcaaacaagatgctgcccaaagtcttttttagcaaatctagaatcaaggagtttgaaccgtcagaggcaataatcaactgctacaagaaaggcacccataagaagggaaagaattttaaccttactgactgccaccggctgatcaactttttcaagactagcatcgagaagcatgaggattggtcaaaatttggcttcaaattctccgacacggaaacctacgaggatatctccggtttctacagagaagttgagcagcaaggatacaggcttacgtcacatcccgtctcagcatcttacatacattcactcgtgaaggagggtaagctctacttgtttcagatctggaataaggacttttctcagttttctaagggaacgccaaatctccatacactctattggaaaatgctcttcgacaaacgcaacctctcagacgtcgtgtacaaactcaatggccaggcggaagttttctaccggaagtctagcattgagcatcagaatagaatcatccacccggcgcagcatccaattacgaataagaatgagctcaacaagaagcatacatctacatttaagtacgacatcataaaggacaggcgctacacagtggacaagtttcagttccacgtcccaattacgataaactttaaagcgacagggcagaacaacatcaatccgatcgttcaggaggtgattagacagaacggcatcacgcatattataggaatcgatagaggtgagcggcacctcctttacctctctcttatcgatctcaagggcaacattattaagcaaatgactctcaacgagattatcaacgagtacaagggagtgacgtacaaaaccaactatcacaatctgctcgaaaagcgcgaaaaagagcgcactgaagctcgccactcttggtcatctattgagtcgattaaggagttgaaggacggttacatgtcccaagtgattcacaagatcaccgacatgatggtcaaatacaacgcaatcgttgttctggaggacctcaatggcggatttatgaggggccgccaaaaggtggagaagcaagtgtaccagaagttcgagaaaaaattgattgacaagttgaattacctggtggataagaagttggacgcaaacgaggtcggaggcgttttgaatgcgtaccagctgaccaacaaattcgagtccttcaaaaaaatcgggaagcagtcaggtttcctgttttacatacccgcctggaatacctccaagatcgatccgatcaccggttttgtcaatctgttcaatacacgctacgaaagcattaaagaaacaaaggttttttggtctaagttcgacataatccgctataacaaagaaaagaattggttcgagttcgttttcgactacaatacgttcactacaaaggctgagggcacaagaacgaagtggacactctgcactcacggcacaaggatacagacgttcagaaaccctgagaaaaacgcccagtgggacaataaagagatcaacctcactgagagctttaaggctttgtttgagaaatacaagatagatatcacttctaatctgaaggaatctataatgcaagagacggagaagaagttctttcaggagctgcataatcttctccatctcacacttcagatgaggaactcggttacgggcacagatattgattacctcatttcccctgtcgctgacgaagatggcaatttttacgatagcaggattaatggcaaaaactttccggagaacgcggatgcgaacggcgcatacaacattgcgagaaaggggcttatgctgataaggcaaatcaagcaggcagatcctcaaaagaagtttaagttcgagacaataacgaacaaggattggttgaagttcgctcaagataagccctacctcaaagactga

SEQ ID NO: 199 - DNA, 3795 bp, Prevotella brevis ATCC 19188
  Cpf1 (1)..(3795)
atgaagcagtttactaatctttaccaactgtcaaagaccctcaggttcgagctcaaacccattggaaagacactcgagcatataaacgctaatggcttcatcgacaacgatgctcatcgcgcggagagctataagaaggttaaaaaactcatcgacgattaccataaggattacattgaaaacgtcctcaacaactttaagctgaatggagagtacttgcaggcctatttcgacctgtactcacaggatactaaggacaaacaatttaaggacattcaagataagcttaggaagtcaatcgcttccgcgctgaaaggcgatgatcggtacaagactatcgataagaaggagctgattaggcaagatatgaaaaccttcctgaagaaagacaccgataaggcgcttctcgatgagttctatgaatttacgacgtacttcactggctatcacgagaataggaagaatatgtattccgatgaagctaaatcaaccgctatcgcttataggttgatccacgacaatctcccgaaattcattgacaatatagcagtttttaagaagattgctaatacgtccgttgcggataactttagcactatttacaaaaacttcgaggagtatttgaatgttaacagcattgatgagatttttagcttggattattataacatcgttctgacccagacgcagattgaggtttataattcaattataggcggcaggacgctggaggacgacacaaaaattcagggcatcaacgaattcgtcaatctttacaaccagcaacttgcaaacaaaaaggatcggctcccgaaactgaagccgttgttcaagcagatcttgtcagatcgcgtgcaattgtcatggctccaagaagaattcaatacaggcgccgacgttctgaacgccgtgaaggaatactgcacttcatacttcgataatgtggaggagtcagtgaaggtcctcctcaccgggatatccgactatgacctgtccaagatttacatcacgaacgacctcgcactcacggatgtctcacagaggatgttcggcgaatggtcgatcattcctaacgcaatcgagcagagactccgctccgacaatcctaagaaaaccaatgaaaaagaggaaaagtactcagatcggatttccaaactgaagaaactcccaaaatcttatagcctgggttatatcaacgagtgcatttctgaactgaatggcattgacatagccgactattacgctactctgggagccataaacaccgagagcaaacaagaacccagcatcccgaccagcatacaggtgcactacaatgctcttaaaccaattctcgatacagactatccgcgggagaagaatttgtcccaggataagttgacagtgatgcagcttaaggatttgcttgacgacttcaaggccctccagcattttataaagcccctgttgggcaatggcgacgaggctgaaaaagacgagaagttctacggcgaacttatgcagctctgggaagtcatcgattcaatcacgcccctgtataataaagtcagaaactactgtacgaggaagccctttagcacagagaaaattaaggttaactttgaaaatgcgcagctcctggacggctgggacgagaacaaggagtccacaaacgcctcaattatcttgagaaagaacggtatgtactatctggggatcatgaaaaaggagtaccggaacattctcacaaaaccgatgccgtctgatggcgattgttacgacaaagtggtttacaagtttttcaaggacatcacaactatggtgccgaagtgcaccacacagatgaagtcagtcaaggagcacttctcaaactccaacgatgattatactctgtttgagaaggacaagtttatcgcaccggtggtcatcaccaaggaaatttttgatctcaacaacgtgctttataatggagtgaagaagtttcaaatcggttatctcaacaataccggtgactcattcggctacaatcacgctgtggagatatggaagtcgttttgtctgaaattccttaaggcatataaatccacctcgatctacgatttttcgtccatagagaagaacatcggctgctataacgatctcaactcgttctacggcgctgtcaatcttctgctgtataacctgacatataggaaggtgtctgtggattatatccatcaactggtggatgaggataagatgtacctttttatgatttacaacaaggacttctccacttacagcaagggaacgcctaatatgcacaccctgtactggaagatgcttttcgacgaatccaacctgaatgatgtggtgtacaagcttaatggacaggccgaagtgttttaccgcaagaagtccatcacctatcaacacccaactcatccggcgaacaaaccaatagacaataaaaacgtgaataatcccaagaagcaatctaacttcgaatacgacctcatcaaggacaagcgctacaccgtcgacaagtttatgttccatgtgccaataaccctcaattttaagggaatggggaacggcgatattaatatgcaagtccgcgaatacatcaagacgacggacgatcttcattttatcggcattgatcggggtgagcgccatctgctgtacatctgcgtgatcaatggaaagggggagatagtcgaacagtactcgttgaacgaaatcgttaataactacaaaggtaccgaatataagaccgattatcacaccttgctttctgaacgggacaagaaaaggaaggaagagcgctcgtcttggcagactatagaagggatcaaggagcttaagagcggttacttgtcacaggttatccataagattacgcagcttatgatcaaatacaacgccattgtcctcttggaagacctgaatatgggatttaagaggggccgccaaaaggtggagagcagcgtctaccaacagtttgagaaagccctgatcgataaactcaactacctggtggacaagaataaggatgccaacgagattggcggcttgctgcacgcataccagctcacaaacgacccaaagctgccaaacaaaaatagcaaacaatcgggtttccttttctacgtgcctgcgtggaacacgtctaagattgatccggtcacaggattcgttaatcttcttgacactcgctacgaaaacgtggccaaggcacaagcattcttcaagaagttcgactctatccggtataataaggaatacgacagatttgaattcaagttcgattactcgaattttacagcaaaggccgaggacacgcggacccagtggacattgtgcacatatgggacgcggatcgagacgtttcggaacgcggagaaaaattcgaactgggactccagagagatcgacctcaccacggagtggaagaccctgttcacacagcacaacattcctttgaacgcgaacctcaaggaggccatcctcttgcaggcaaataagaatttctataccgacatactgcacctgatgaaactgacactgcaaatgagaaattcagtgacaggaacggatatagactacatggtctccccagtggctaatgaatgtggggaattctttgactcaaggaaggtgaaggagggcttgccagtcaatgcggatgccaatggggcctataacatcgcgcggaaaggcctctggttggcgcagcaaatcaagaacgccaacgacctttccgatgttaagttggcgattactaataaggagtggcttcaatttgcacagaagaagcaatatctgaaggattga

SEQ ID NO: 200 - DNA, 3918 bp, Eubacterium sp.
  Cpf1 (1)..(3918)
atgaataaggctgcagataattataccggcggcaactacgatgagttcattgcgttgtccaaggttcagaaaacactgaggaatgagctgaagccaacaccattcaccgcagaacatattaaacagagaggaattatttccgaggacgagtacagagcccaacagtcgctcgaactgaagaaaatcgccgacgagtactatagaaactacatcactcacaagctgaacgatattaacaacttggacttctataatctcttcgacgctatcgaggagaagtataaaaagaacgacaaagataatcgggacaaactcgacctcgtcgaaaagtcgaagagaggagagattgcaaaaatgctgagcgccgatgacaacttcaaatcgatgttcgaggctaagcttataacaaagctccttcctgactacgttgagcgcaactatacgggcgaggacaaagagaaggccctggaaactttggcactctttaagggatttacaacttacttcaaaggatacttcaagactaggaagaacatgttttcaggcgagggaggcgcttccagcatctgccacaggattgttaatgtgaatgcctccattttctacgacaatttgaagacgtttatgagaatccaagagaaagcgggagatgagattgcgcttatcgaggaagagctgactgaaaaacttgatggctggcgcttggagcatattttcagcagggactattacaacgaggtcttggcgcagaagggtattgactattacaatcaaatctgtggagatataaacaaacatatgaacctgtactgccagcaaaataaattcaaggcgaacatatttaagatgatgaaaatccagaaacagattatggggatatcggagaaagcgttcgagatcccccctatgtatcaaaatgatgaagaggtctatgcaagcttcaacgagttcatctcccgcctcgaagaggttaagctcaccgacaggttgattaacattcttcaaaatattaacatttacaacactgccaagatctacataaatgcaaggtactacactaacgtcagctcttatgtttacggcggctggggtgttatcgattcggctattgagcgctacctgtacaataccatcgctgggaagggtcaaagcaaagtcaaaaagatcgaaaacgccaagaaagacaacaaattcatgtctgtgaaagagctcgactctatagtggctgagtatgaaccggattatttcaacgcgccctatatagatgacgatgataatgctgtcaaggcgttcggaggacagggtgtccttggctacttcaacaagatgtcagaacttctcgcagacgtgtccctctatacaattgattacaattcagatgactccctcattgaaaataaggagtcagctctgcgcataaaaaaacagctggatgatatcatgtctttgtatcactggctccaaacattcattattgatgaagtcgttgagaaggacaacgcattctacgcggaacttgaggatatttgctgcgagcttgaaaacgttgtgacactgtacgatcgcatacggaattacgttacaaagaaaccatattccacacagaagtttaagcttaattttgcttcgccaacgttggccgccggttggtccaggtccaaggagtttgataataacgccattatactcctgagaaacaacaagtactatattgccatctttaatgtgaacaacaagccggacaagcaaattatcaagggctctgaagaacaaaggctctcaaccgattataaaaagatggtgtacaatctcctgcctgggcccaacaagatgttgcctaaggtcttcattaagtccgataccgggaaacgcgactacaatccttcatcgtacatacttgaaggctatgagaaaaaccgccatattaagtcaagcggcaacttcgatatcaactactgtcatgaccttattgattactacaaggcatgtatcaataagcatcctgagtggaagaactacggcttcaagttcaaggaaactaatcagtataatgatatcggccagttctacaaagacgttgagaagcagggttactctatctcgtgggcctacatctcagaggaggacattaataagttggacgaggaagggaagatctatctcttcgagatttataataaggacctcagcgcgcatagcaccggccgcgataaccttcacacgatgtacttgaagaatattttcagcgaagataacctcaaaaatatctgtatagagcttaatggggaggcagagctcttttaccggaagagctccatgaagtctaacataactcacaaaaaggacaccattctggtgaacaaaacctatattaacgaaacaggggtgcgggtgtccctctccgacgaggactacatgaaggtctacaattactacaacaacaactacgtgatcgacactgagaacgataaaaatttgattgatatcatcgagaagatcggacaccggaaatcgaagatcgacatcgtgaaggacaaacgctacaccgaggataagtactttctttatctgccaatcacaataaactatggcatagaagacgaaaacgtgaactcaaagatcatagagtacatagcgaaacaggataacatgaacgttatcggcatcgatcgcggagaaagaaatctcatctacatttctgttatagataataagggcaacatcattgaacagaaatccttcaacttggtgaacaactacgattataaaaataagctcaagaacatggagaaaacacgggataacgcgagaaagaattggcaggaaattggtaagattaaggatgtcaagtccggctatctgtcgggcgtcataagcaaaattgctcggatggtgatcgattataatgcgatcattgtcatggaggacctgaacaaaggctttaagagggggaggttcaaggtggaacggcaagtgtaccaaaagtttgagaacatgcttatttcaaaacttaactatctggtctttaaagagcgcaaggcagacgagaacggcggcatcctcagaggctatcagctgacgtacattccgaagtctattaagaacgtgggcaagcagtgtggctgtatattctacgttcctgccgcctacacctccaagatagacccagccacaggattcatcaatatattcgacttcaaaaagtatagcggcagcgggatcaatgctaaagttaaggacaagaaggagtttctcatgtccatgaattcgattagatacatcaacgagtgctccgaagagtatgaaaagattggtcatcgggaactttttgcgttcagcttcgattataataactttaagacgtacaatgtgagctcacccgtcaatgaatggacagcctatacctacggcgagaggatcaaaaagctgtataaggatggccgctggcttaggtccgaggttctcaatctgacagagaacctcatcaaattgatggagcagtacaacatcgaatacaaggacggacatgacatacgggaggatatatcgcacatggacgagaccaggaacgcagatttcatatgctccctcttcgaagagctgaaatacacagtgcaactgcggaactccaaatccgaagccgaggatgagaattacgataggctggtgagcccgatactcaattcttctaatggcttctacgactcaagcgattacatggagaacgaaaataatacaacccataccatgccgaaggatgccgacgctaacggggcctattgtatagcactcaaaggcctttacgaaattaataagattaagcaaaactggagcgatgataagaaattcaaggagaacgaactgtatattaacgttacagaatggctggattatatccagaataggagatttgaatga

SEQ ID NO: 201 - DNA, 3858 bp, Microgenomates (Roizmanbacteria) bacterium GW2011_GWA2_37_7
  Cpf1 (1)..(3858)
atgaagtccttcgattccttcacaaacctttactccctctccaagacactcaagttcgagatgagaccagtcggcaacactcagaagatgctggataatgcgggggtttttgagaaagacaagctgatccagaaaaagtacggaaagactaaaccgtacttcgaccgcctgcatagagagtttattgaggaggccctcacgggggtggagctcattggcctcgacgagaacttccgcaccctggtcgactggcagaaggacaaaaagaacaacgttgcgatgaaggcttatgagaactcgctgcagcgcttgcgcacggaaatcggcaagatttttaacctgaaggccgaggactgggtgaagaataaataccctatactgggcttgaaaaacaaaaatacagatattctgttcgaggaggcagtcttcggtatattgaaagctcggtacggggaagagaaagacacttttatcgaggtggaagagattgacaaaactgggaagagcaaaatcaaccagataagcatttttgattcttggaaaggcttcaccggctattttaagaagttttttgaaacgaggaagaatttttacaagaacgatggtacatccacagctatcgcgacgcgcattatcgaccaaaatttgaaaagatttatcgataacctgtccattgtggagagcgtgcgccaaaaggtggacctggcggagacagaaaaatccttctctatcagccttagccagtttttctcaattgatttttacaacaagtgccttctgcaagacggcatagattactacaacaagatcattgggggggagactctcaagaacggagagaaactgatcggcctcaacgaacttatcaatcagtaccggcagaataacaaagatcagaagattcccttctttaaactgttggacaagcagatcctctcggagaagattcttttcctcgacgagattaagaatgatactgagcttatcgaggcgctgtctcagttcgctaaaaccgcggaagagaagacaaagatagtcaagaagctctttgccgacttcgtcgaaaacaactctaaatacgatctcgctcaaatttatatttctcaggaagcgtttaacacaatctcaaataagtggacctcggaaaccgaaacgttcgcaaaatatttgtttgaggctatgaagagcggaaaactggctaagtatgaaaaaaaggacaactcctacaaattcccagatttcatcgcgcttagccagatgaaatctgccttgctttctatatcactcgagggccatttctggaaggagaaatattacaagatcagcaaattccaagaaaaaacgaattgggagcagttcctcgctattttcctctacgagtttaattcactgttctcggacaagatcaatacgaaggacggagagaccaaacaggtggggtactatctgttcgcgaaggaccttcacaacctgatcctttccgaacagatcgacatcccaaaggattcgaaggtcacgatcaaagatttcgcggactccgtccttaccatctaccagatggcgaaatacttcgcagttgagaagaagagggcttggctggcggagtacgaactcgattcgttctacacgcaacctgatacgggttacctccaattctatgacaacgcttacgaggatatagttcaggtctacaacaagctgaggaattacttgaccaaaaagccctattccgaggagaagtggaagcttaacttcgagaactctacgcttgcaaacgggtgggacaagaacaaggagtctgacaattctgccgtcattttgcaaaagggcgggaagtactacttgggtctgatcacaaagggacacaacaagatctttgacgaccgcttccaagaaaagttcatagtgggcatcgagggaggcaagtacgagaaaatcgtgtacaagttctttccggaccaagcaaagatgttcccaaaggtgtgcttctctgctaaaggtctcgagttttttcggccgagcgaggagattctcaggatctacaataacgcagagttcaagaagggggaaacatactccatcgattctatgcaaaaattgattgatttttacaaggattgccttactaaatacgagggttgggcgtgttacacatttaggcatttgaagccaactgaagagtatcagaataacattggagagtttttcagggacgtcgccgaggacggctacagaatcgacttccagggtatatccgatcagtatattcatgagaagaacgaaaagggcgaactccacctgtttgaaatacacaacaaggactggaacctcgacaaagctagggacggcaagagcaaaactacccaaaaaaacctccatacactctattttgaatccctcttctcaaacgataacgtcgtgcaaaacttcccaataaaactgaacggccaggctgaaattttttatcggccaaagaccgaaaaggacaaactggaatcgaaaaaagataaaaagggaaacaaagtcatcgaccacaagaggtattctgaaaataaaatcttttttcatgtgcccctcacgcttaacagaacgaagaacgactcctaccggttcaacgcacagatcaacaacttcttggctaacaataaggatatcaacatcatcggagtcgacaggggggaaaagcatcttgtctactattcggtgatcacccaggcgtcggacatcttggagtctggctctctcaatgagttgaatggcgttaactacgccgagaaactgggaaagaaggcagaaaaccgcgaacaagccagaagggactggcaggatgttcaaggcataaaagatctcaagaagggatacataagccaggttgttcgcaaacttgcggatctcgccattaagcacaacgccattataatcctcgaggatctcaacatgcggttcaagcaagtgaggggagggatagagaagtcaatttatcagcaactcgagaaggcactcatcgacaaactgtccttcctggtggacaagggcgagaagaatccagagcaagccggccacctgctcaaggcgtatcaattgtcagcgcccttcgaaacgtttcagaagatgggtaagcaaacaggaatcattttctacacccaggcgtcatacaccagcaagtccgatcctgtcacgggatggagaccccatttgtatctgaaatacttctctgcaaagaaagccaaggatgatatagcgaagtttaccaaaatcgagtttgtgaatgatagattcgagcttacttacgatatcaaggattttcaacaggcgaaagaatacccaaacaagaccgtgtggaaagtttgctccaatgtggagcggttcagatgggataagaacctgaaccagaacaagggagggtatactcactacactaacattactgaaaacatccaggagctgtttaccaagtatggcattgacatcactaaagatctcctcacgcaaatctctactatcgacgaaaagcaaaacactagcttcttcagggacttcattttttatttcaacttgatttgccaaattcggaatacagatgactcagaaatagccaagaagaacggaaaggacgacttcatcctttcgcccgtggagccattttttgattcgaggaaggacaatggcaataagctgcccgaaaatggcgatgacaacggcgcgtataatatcgcaaggaagggaatcgtcatattgaataagatcagccagtattctgagaagaacgagaactgcgagaagatgaagtggggagatctctatgtctctaatattgactgggataacttcgtcactcaggcaaacgctcgccattga

SEQ ID NO: 202 - DNA, 3255 bp, Smithella sp. SC_K08D17
  Csm1 (1)..(3255)
atggagaagtacaagatcacgaagacaataaggtttaagctcctgcccgataaaatccaggacatatcgcggcaggtggccgtcctgcagaacagcacgaacgcggaaaaaaagaataatcttctgcgccttattcaacgcggccaggaattgccgaaacttctgaatgagtacattagatatagcgacaaccataaactcaaatcgaatgttaccgttcatttccgctggctgcgcctcttcactaaggacctcttctataactggaagaaggacaacactgagaaaaaaattaagatatcagacgtggactacctctccagagtgttcgaagacttctttaacgaatgggaaactgttatcgagaggatcaacactgattgcaacaggccagaagagtcaaaaacacgcgacgccgagatagccttctcgattaagaagatagccactaaacaaatgttcccctttattaagtcctttgtgtataatagcaattacaagaactcggaggaaaccaagtccaaattgacagcgctgcttaatgagttcgagactgtcttgaaaatctgcgagcagaattacttgccctctcagtcagcagggatagttatagcgaaagcttctttcaactactatacaataaataagaagcaaaaggattacaaagggtatacggacgacatcgaaaagatagagaagggcatgaactctaagttccattacgaaaggaagtacgatcagctcctcgaggagctgaaccttatcgccctgaaggagctgccgttgattgagttctacagcaagatcaagtcctataagtcaacaagaaagatcgagttctctgaggctgtgtcaaaggggctggcgtttgcagacctcaagagcaagtttcctctctttcaaaccgaatcaaataaatatgctgagttccttgaactgaccggacgcatcactcagatttctactgccaagtcactgctctctaaggacaaccctgaagcgcaaaagctcagggacgagattaaaaagcttcggatcaatcgcggagaatatttcaaaaataactttcataagtacatctcactttgcaacctgtacaaaaagatagccgacaaaaagggcagactgaagggacaagtcaaggggatcgaaaatgagaggattgactcgcaaaggatccaacactgggcgcttgttcttgaggataatctcaagcacagcctgattcttattcctaaggagaaagttaccgaagtgtatagaaaggttagggcctcaaaagctgattctacgtcctcgtcaagctctttgtattacttcgagtccatgacttaccgggcgcttcataagctgtgcttcggtgtcaatggaaacacgttcctccccgagatccaaaaagagctccctgaatataaccccaataagcaatctgatttcggcgagttttgcttccataagtcgaatacggataaggaaatcgatgagcccaagcttatttccttctaccaatccgtgctgaagacgaactacgtgaaagataatttgaacctgccgcagtccgtgtttgacgaagcaaccgttcaaacctttgaaacaagacaagattttcaaattgccctggaaaagtgctgctatgcgaagaaaactatcattagcgagaccctcaagaaagaaatattggaggataataacgttcagatctttcagattacctccttggacctgcagaggagcgaacagaagaacctgaaggcgcacactaagatatggaatcgcttttggacaaaacagaatgaaacagccaattacgaccttagacttaatcctgagaccgccattgtgtggcgcaaaccgaaaaaaacgcgcattgacaagtatggcgccggtacgtcactctacgacccaaagaagagaaaccggtacctgcacgaacaatatactctttgtacgactgtcactgacaacgcgttgaacaacgagatcacatttgctttcgaagatacaaaaaagaaggggaccgaaatagtcaagtataacgagaaaattaaccagacactgaaaaaggagttcaacaaaaatcagttgtggttttacgggattgacgcgggcgagatagagctcgcgacattggctctcatgaataaggacaaagaaccccagcttttcactgtctacgaactgaagaaatcagatttcttcaagcatggctacatctacaacaaggagagggagttggtgatcagagaaaagccctataaggctatccagaacctttcttactttctcaatgaagaactttatgagaagactttccgcgacggcaagtttcaggagacttttaatgagctgttcaaagagaaacacgttagcgccatcgacttgacgactgctaaggttattaatggcaagatcatcctgaatggagatatgataacattcctgaatctgcgcatcttgcacgccaagaggaagatttacgaagagctgatcatcaatcctcaagccgaactgaaggagaacgagaaggaatattacctgtatttcgataaggagggtacggagaaggtcgagaaaatttacaggtcgaggttggattttgagcacatcaaaccctaccaagagatcagaaacgatcttaacgcctatttcaaaaacgtgcaaaaaaatgaggctaaggtcgaagatcagattaatcaaactcgcagagcccttgtgggtaatatgataggagtcatttactatctgtatcagaagtaccggggaattatttcaattgaagatttgaagcagactaaggtggagtccgatcgcaataaattcgagggcaacatagaaaggcccctggaatgggctctgtaccgcaagttccagcaggaagggtacgttccccccatttcagaactcattaagctgcgcgaactcgagaagttccctctcaaggatgtcaaacaacctaaatacgagaatatccaacagttcggtatcatcaaattcgtgagcccggaggaaacgagcaccacctgcccttcatgcgaaaagaaggcgtacgagctgcagaaggagaagaagggtgaggagaagccagccgagaacaagaggtatgaagccgataagaaggcgggcgtcttctgctgtcctaagtgcgggttccataaccgcacaaatcctatgggctacgaatcccttgactccaatgataaagtcgccgccttcaacatcgccaagcgcggtttcgagcaaaactttcggcagtga

SEQ ID NO: 203 - DNA, 3753 bp, Smithella sp. SCADC
  Cpf1 (1)..(3753)
atgcagacgttgtttgaaaacttcactaaccaatacccagtttccaagactctgcgcttcgagctcattccgcagggcaagactaaagacttcattgaacaaaaaggacttctgaagaaagatgaagacagagctgaaaagtacaagaaagttaagaatataatagacgaatatcacaaggatttcatcgaaaagtcccttaacggtctcaagctcgacggcctcgaggaatacaagacactgtacctcaaacaggagaaggatgacaaggataaaaaggcgttcgacaaggagaaggaaaacctccgcaagcagatagcaaatgcgttccggaacaacgagaagttcaagactctctttgcgaaagaacttatcaagaatgacttgatgtcgtttgcctgcgaagaggacaaaaagaatgttaaggaattcgaagctttcaccacttactttactgggttccatcagaatcgcgcgaacatgtacgtcgctgatgagaagcgcacggcaattgcgtcaaggctcattcacgagaatctcccgaaattcattgataacattaagatattcgagaagatgaaaaaggaggcccctgagctgctctccccttttaatcagactctcaaggatatgaaagacgtcatcaagggaacgacccttgaagagattttctctctggactattttaacaaaactcttacgcaatcaggcatcgatatatacaactctgtcatcggcggcagaacacccgaggaagggaagaccaaaattaaaggtctcaatgaatatattaacaccgacttcaatcagaaacaaaccgataagaagaagagacaacccaagttcaagcagctgtacaagcagattctttcagataggcagtctctttcgttcattgcggaagctttcaagaacgataccgagatcctcgaagcaatcgagaagttttacgttaacgagctccttcacttttcaaatgagggaaagtcaacaaacgtccttgatgctataaagaatgccgtctccaatcttgaatctttcaacctgacaaagatctactttagatccgggacgtcgctgaccgatgtgtcacgcaaggtgttcggcgagtggagcatcatcaatcgcgcccttgacaactattacgctactacgtacccgatcaagcctagggagaaatccgaaaagtacgaggaacgcaaagagaaatggctcaaacaggattttaatgtgtccctcatccaaacagcgatcgacgaatacgataatgagactgtcaaggggaagaactcaggcaaggtgattgtcgactactttgctaagttctgcgacgataaagagaccgatctgattcagaaggtgaatgaaggatacatagctgtcaaggacctgctgaacaccccgtacccagaaaatgaaaaactcggttcaaataaggaccaggtgaaacagataaaggcatttatggactctattatggacatcatgcattttgtcaggccgctttcattgaaggataccgataaggagaaagacgaaacgttttatagcctgttcacccctctttacgatcaccttactcagactatcgccctctataacaaagtccgcaattatttgactcagaagccgtactcgaccgagaaaataaaactcaatttcgagaattccaccttgctcggtggatgggatcttaacaaggagactgacaacactgccatcatattgcggaaggagaacctctactacctcgggattatggataagcgccacaaccgcattttccgcaacgttccaaaggccgataaaaaagacagctgctatgagaagatggtctacaagcttctgcctggcgcgaacaaaatgttgcccaaggtgtttttcagccaatcgcgcattcaagaatttacgccatcggcaaagcttctcgaaaattatgagaacgagacccataaaaaaggggacaattttaatcttaaccattgccatcagttgattgatttcttcaaagacagcattaacaagcacgaggattggaagaacttcgacttccgcttttcggccacctctacatacgctgacctctcaggcttttaccacgaggtggagcatcagggctacaaaatatcatttcaatccatcgcggattcattcattgatgatcttgtcaacgaggggaagctgtaccttttccaaatttacaacaaggacttctctccgtttagcaagggcaaaccaaacctccacaccctctattggaagatgttgttcgatgagaacaatttgaaagatgtggtttataagctgaacggggaggccgaagtgttttatagaaagaagagcatagccgagaagaacactaccattcataaagccaatgaaagcattatcaacaagaacccggacaacccgaaggccacttccacatttaactatgatatagttaaagacaagcggtacaccatagataaatttcagtttcatgtgcctatcacgatgaatttcaaggcagaaggcatctttaatatgaatcagcgcgttaatcagttccttaaggctaatcctgatatcaacattattggcatcgataggggcgagcggcacctgctgtattataccctcattaatcaaaagggcaaaatactcaaacaggacactctcaacgtcattgccaacgagaagcaaaaagtggattaccataacctcctggataaaaaagagggtgatagggcgaccgcgagacaggaatggggcgttattgagactatcaaagaattgaaagaaggatatttgagccaagtgattcataaacttacagatttgatgatagaaaacaatgcgattatagttatggaagatctgaactttggctttaagcgcggcagacagaaagtggagaaacaagtttaccagaagtttgagaaaatgctgatagataagctgaactacctggttgataagaacaagaaagctaatgagctcggcggtctgctgaacgcatttcagctggcgaataaatttgaatcctttcagaaaatgggtaagcagaatggttttatattttacgttcccgcgtggaacacgtccaagacggaccccgctacgggtttcatagacttcctgaagccgagatacgagaacctcaagcaagccaaggatttcttcgagaagtttgattccataagactcaattccaaggccgattacttcgaattcgcattcgacttcaagaactttactgggaaagccgatggcggtaggacgaagtggaccgtctgcaccaccaatgaagatagatacgcatggaatagagccctcaacaacaacaggggctcgcaagagaaatatgacatcactgcagaacttaaatctctctttgacggtaaagtcgactacaagtcaggtaaggacctgaaacagcaaatcgcctcacaggaattggccgatttcttcaggacactgatgaagtatcttagcgtgaccctcagcctcaggcataataacggggagaagggagagactgaacaggactatatcctctcacctgtggccgattccatgggcaaattctttgactctcgcaaagccggcgatgacatgccaaagaatgccgacgcgaacggcgcttaccacattgcccttaagggtctttggtgcctcgagcaaatcagcaaaacagatgacttgaagaaggtgaaactggctatctcaaataaggagtggcttgagttcatgcagaccttgaaaggttga

SEQ ID NO: 204 - DNA, 3924 bp, Succiniclasticum ruminis
  Cpf1 (1)..(3924)
atgggtaatttcggtgaatttacacataagtatcaggtctcgaagactctgaggttcgagctgattccacaaggcaagacccttgaaaacgtcgcaaagtacggcatagtcgacgacgataagaggcggtctgaaaattacaaaaagctgaaaccagttattgaccgcatttacaaatatttcattgacgagtcgttgaagaatgtcagcatcgattggcaacctttgtatgaggcgatcatagcctacagaaaggaacagactacggccaatgtggtgcggctcaaggaagagcaagaggcgtgccggaaggccattgccgcctggttcgaggggaaggtgcctgataaaggttctaaagatctcaaagaatttaataagacgcaaagcaaactcttcaaggaactcttcggcaaggagctcttcactgagtccgtcacacaacttttgcccggcctgtctcttacggaggaggagaaggaactgctcgccagcttcaacaaattcacatcgtatttcaagggcttttacgttaatcgcaagaacgtcttttctgccgatgacatctcgacgagcatcccacatcgcttggtgcaagagaattttcctaagtttatggacaattgcgaagcttatcggagaatcgtggaagagtaccctgaactcaaggccaagctcgaagggactgcacaggcgacgggtatcttcattgggttcaagttggacaatatatttaaggttagcttttacaatcacctgctgcaacagtcgcagatcgatctttacaaccagttcctctgcggaattgcgggtgaagaaggaacgatgagggtccaggggctgaacgtgaccctcaatcttgccatgaagcaagacaaagtcctcggtcagaagcttaaatcaatgccgcatcgctttattccgctctataaacagatcctttccgaccggactaccctgtccttcattccagaagcatttcaaaacgatgaggaagtcctcctcaccgtcgaagaatatcggaaatccctcgaggcggagcgcacgaccggtgcagtttcggatattttcaactcactgcaggcggccgacctccggcatgtctatgtgaatccagctaagctgacagcgtttagccaaatgctgtttgaagattggtccctttgtcgcgagtcgctccggaattggaagttgcggagctacggcaaagcagctacaaagaaagttagagaagagatcgagtcgtggctcaaggagagcgccataagccttgatgaactgcaggcggccctcgctgacggaactctctcagttatcatcaatcagaaggtgcagtcagttataacgactcttgagcaagagctcgccaaacccctcccaaagaagcttaaaacagccgaggaaaaggagtccctcaaatcgctgctcgactcagtccaggaagcatgccatagcctggagatgttcgcggtcggggaaaacatggataccgacccttgtttctacgtcccgctgcgggaggccatggaagcaattcagccaataattccactgtataataaggtgagaaactttgccacgcaaaaaccttattcaattgagaaattcaagttgaatttttctaaccccatactggcaagcgggtgggacgagaatagggagcggcaaacctgcgcaatactctttcgcaagggagagaagtactaccttgggatatacaacgcgaaggttaagccagacttttcaattatcaaagcggtgaagggtggcaactgcttcgagaaggtggtctacagacagttccctgatttttccaagatgatgcctaagtgtaccacacaactgaaagaggtccagcagcacttcgcgtcgagcagcgaggactatgtcttgtacaataagaaatttatcaagccgcttacgataaccaaagaaatttatgatctcaacaacgtcctcttcgatgggaaaaaaaagttccaaatcgattacctgcggaagactaaggacgaggacggatactaccacgcgcttcacacgtggatcaatttcgcaaaggagtttgtcgcttcgtacgagtcaacctcgatttatgatacaagcactgtcctgtctacggagcaatacgtgaagcttaacgatttctacggtgatctcgacaacctcttttataggatcaaattcgaatccgtctccgaagagacaatttctgaattcgttgacgagggtaaattgttcctctttcaaatttacaacaaggactttgcggagggtgcaaccggcgcccccaatctccacacgatttattggaaggccgtgtttgatccggagaacatgaagaacgtcgtggttaagctcaacggccaagcggaactcttctaccggcccaagtccgcaatggatatagttaggcacaaggttggcgagaagttggttaatcgccgccttaaggacggcacgtcacttacagaggagctccatgaggagctttacctttacgccaacgggaaactgaagaagaaactgtccgaggcagcggctgctgttctcccccaggcagtcatttacgatgttcaccatgaaatagtcaaggacaggcggttcaccgaagataagttcttctttcacgtcccattgacactcaactacaagtgcgacaaaaatgccgtccagtttaatgcctcagtgcaagagtatcttaaggagaacccagacacatacataataggtatcgaccgcggcgaacggaacttgatttatgccgtcgtcattgatcctcaaggcaatatagtggaacagaagtcgttcaacgtgattaacggcttcgattaccataataaattggaacagcgcgagaaggaacgcaataaagcaaggcaggactggacgaccgtgggtaaaattaaggagctcaagcagggttacctttccttggtcgttcacgaaatcacgtccatgatggtgaagtacaatgctatagtggtgctggagaacctgaacgtcggtttcaagcgcatacggtcaggaatcgctgaaaaggccgtctaccagcaattcgagaaaatgctgataaacaagctcaattacttgatgttcaaggacgtggagggggcaaagccggggagcgtgttgaatgcttaccaactcacagaccggttcgagtctttcgcatcgatgcgcaatcagactggcttcctcttctatattccggcagccttcaccagcaagatcgaccccgccaccggattcgtggacccattctgctggtcagctattaagaccctggatgacaagaaaacatttatatctggattcgatacactgaaatatgacaacgtcaccggcaatttcatcctgcatttcgaaatgaagaagaataaggacttccaaaaaaagttggaaggtttcatgccggagtgggacatcgtggttgaagctaataaggatagacgggatgctgagggaaaaactttcatcagcggcaagcgcatagagtttgtcagagagaataatggccacggccactacgaggattacctgccttgcaagaagcttgtggaaatactcagacagtacgacatattgttcgaggatggcaaagacgtgctccctctgataatgaagaatggcgactccaagcttatacatgaagtttttaaggtgatcagattgtcactccaaatgagaaacagcaatgcggaatcgggagaagatttcatctcgtctcccgtcgagaacaatgaagggatatgttttgattcacgccttggggtcgagacgctgcctaaggatgctgatgcgaacggggcgtatcatatcgctttgaagggcttgctccttctcgagaaaataagacacgacgaacggaagttgggaatctccaattcagagtggctcaaccacattcagtctcttaggggttga

SEQ ID NO: 205 - DNA, 3786 bp, Eubacterium coprostanoligenes
  Cpf1 (1)..(3786)
atggactttttcaagaacgatatgtattttttgtgcataaacggaatcatagtcatctcgaagttgttcgcgtacctgtttcttatgtataagagaggcgtggtgatgatcaaagataactttgttaacgtttattcgctgtcaaagacgattaggatggctctcataccctggggaaagacagaggacaacttttataagaagtttcttctcgaggaggatgaggagcgcgccaagaactacattaaggtgaagggctacatggacgagtatcacaagaacttcattgaatccgctcttaactcggtggttctgaacggggtggacgagtactgcgaactttacttcaaacagaacaaatccgattcggaggtcaagaaaatcgagtccctggaagcttcaatgcggaagcagatttcgaaagccatgaaagagtatacagtggacggggtgaagatatatccactgttgtcaaaaaaggagtttatccgggagttgctcccggagtttttgacgcaagatgaggagatcgaaaccctcgaacagttcaacgatttcagcacctatttccagggtttctgggagaatcgcaaaaacatctatacggatgaagaaaagtcgactggtgtcccttaccgctgcataaatgacaatttgccaaagttcctggataatgttaagtcatttgagaaagtcatcttggctctcccgcagaaggcagtggatgaacttaatgcaaacttcaatggtgtttataacgtcgacgtgcaggatgtgttctcggttgactacttcaattttgttctttcccagtcaggaatcgagaagtataacaacattattggcgggtactcgaattcagatgcttccaaggttcaggggctcaacgaaaagattaacctctacaaccagcagattgcgaagtccgacaagagcaagaagctgcctctgctgaagcctctctacaagcagatactctctgataggtcgtctctcagcttcattcctgagaaatttaaggacgataacgaggtgctcaactcgattaacgtcctgtatgacaacattgcagagagcctggagaaggctaacgatctgatgtccgatatcgcgaattacaacacggacaacattttcatctcatctggggtcgcggttacagacatatcaaagaaggttttcggtgattggtcactgatcagaaataattggaacgacgagtatgagtcgacacataagaagggcaaaaacgaagaaaaattttacgagaaggaggataaagaattcaaaaagatcaaaagctttagcgtcagcgagttgcaacgccttgccaattcggatttgtctattgttgattatttggtcgacgaaagcgcgtcactgtacgccgacatcaaaacagcctataacaacgctaaggacctgctgagcaatgagtactcgcactctaagcgcttgtccaaaaatgacgatgccatagagctgatcaagtccttcctcgacagcattaagaattatgaggcgttccttaaaccattgtgcggcacaggcaaagaggagtctaaggacaatgcgttttacggagcgttcctcgagtgctttgaagagatacggcaagtggatgcggtttacaacaaggtgcgcaatcatattacacagaagccgtattccaacgataaaattaagctcaattttcagaatccacagtttttggccggctgggataagaacaaggagagagcttaccggtcagttcttttgcggaatggggagaagtactacttggcaatcatggaaaaaggaaagtcaaaactttttgaggactttccggaggatgaatcctctccgttcgagaagatcgactacaaactgctccccgagccatccaagatgctcccgaaggtctttttcgcaacttccaacaaggacctgttcaaccctagcgacgagatccttaacattagagccacaggctcctttaagaaaggggattccttcaacctcgatgattgccataaattcatcgacttttataaggccagcattgagaatcacccggactggtctaaattcgacttcgacttcagcgagactaacgattacgaggacatctcaaagttcttcaaagaggtgtcggaccaaggctactcgatcggatatcgcaagatttcggagtcatatctggaggaaatggtggacaacgggtctctgtacatgttccagctgtacaataaggacttcagcgagaaccgcaagtcaaaggggacaccgaatcttcacaccctttacttcaagatgttgttcgacgaacgcaacttggaagatgttgtttacaagctttcgggtggggcggagatgttttaccgcaagccaagcatcgacaagaatgaaatgattgttcatccgaagaaccagcctatcgataataagaaccctaataacgttaagaagacatcaacgttcgagtacgatattgtcaaagacatgaggtacacaaagccccagttccagctgcacctgccgatcgtgctcaatttcaaggcaaattctaaggggtatattaatgatgatgtgcgcaatgtcctcaagaattccgaggatacttatgttatcggaattgatcgcggagagaggaatcttgtttacgcgtgcgtcgtggacgggaatgggaaactggtggaacaagtgcccctgaacgtgatcgaggcagacaatgggtacaagacagattaccacaaactcctgaacgaccgggaggagaagaggaacgaggcgagaaagtcgtggaagaccatcggaaacataaaggagctgaaggaggggtatatttcccaagttgtccacaaaatatgccaactcgttgtcaaatatgacgcagtgatcgctatggaggacctcaatagcggattcgtgaacagcaggaagaaagtggagaagcaggtctaccagaaatttgagcgcatgctgacccaaaagctgaattacttggttgataaaaaactcgatccaaatgagatggggggcttgctgaacgcgtaccaactcacgaacgaggcaaccaaggtcagaaatgggagacaagatggtataattttctatattccagcgtggctcacgtcaaagattgatcccactacgggctttgttaatctgctcaaaccaaagtataacagcgtgtcagcctctaaagaatttttttccaagtttgatgagataagatataatgaaaaggagaattatttcgagttctcgttcaattatgataattttcctaagtgcaacgcagactttaagcgcgaatggacggtgtgtacgtatggcgaccgcatccggactttccgcgatcccgagaacaataacaagttcaattcagaggtggtcgtcctcaatgatgagttcaaaaacttgtttgtcgagtttgatatagactatacggacaaccttaaagagcaaatccttgccatggatgagaaatctttctataaaaaattgatgggcctgttgtccctgacgctgcagatgcggaattcgatctcaaagaatgtggacgtggactacctcatctcccctgtgaagaacagcaatggcgaattctacgactccagaaactatgatattactagcagcctgccgtgtgacgctgactccaatggtgcttacaacattgcccgcaagggcctttgggctatcaatcagattaagcaggcagacgatgagactaaagcaaacatttctattaaaaatagcgagtggttgcagtacgcccaaaactgcgacgaagtctga

SEQ ID NO: 206 - DNA, 3795 bp, Moraxella lacunata
  Cpf1 (1)..(3795)
atgctctttcaagagttcactcatctctacccgctctccaagacggtcaggtttgagcttaagccgatcgggaagaccttggaacatattcacgccaaagattttcttagccaggatgagaccatggccgatatgtaccagaaggtcaaggcaattctcgacgactaccatcgggacttcattgccgatatgatgtccggcgttgtgctcacaaagttggccgaattttatgaggtttatctggcccttcgcaaaacaccaaaggatgacagcctgcagaaacaattgacggagatacaaacggctctgaggaaagaaatcgtgaaacccatcggaagcggcggaaaatacaaggccgggtacgaccgccttttcggtgctaagctgttcaaggatggcaaagaactcggggacttggcaaaattcgtgattacgcaggagggtgagtcctccccgaagttggcacatattgcccacttcgaaaaattctcgacctatttcacggggttccatgacaacaggaagaacatgtactccgatgaggacaaacatactgctatcgcgtatcgcctgattcacgagaatctccctagatttattgataatctccaaattttggcgacaataaaacagaaacactcggccctctacgaccagattgttaatgagctcaatgcgaacggcctggatgttagcctggcgtcgcacttggacggctaccacaagcttttgacccaagagggaatcacagcttataacacccttctggggggcatttccggagaggcagggtccaggaagattcagggcattaacgagctcataaacatccatcataatcagcactgccaaaagagcgaaagaatagccaaactgcgcccactgcataaacaaatcctgtccgacggaatgggcgtgagctttcttccgtcgaagttcgcggatgattctgaagtctgccaagcagttaatgagttttaccgccattacgctcatgtcttcgccaaggtgcagtccctgttcgacagatttgacgattatcggaaggatggtatttacgttgagcacaagaatttgaacgagctctcaaagcaagcgttcggcgactttgcgctgctgggcagggtccttgacggctattacgtggacgtcgttaatcccgagttcaatgaaagattcgctaaggccaaaacagacaatgctaaagaaaaacttactaaggaaaaagacaagtttatcaaaggtgttcactcgttggcctcactggaacaagcgattgagcactatatagcaggtcatgatgacgagtctgtgcaggccggcaagctgggacagtacttcaaacatggcctcgctggagtggacaatcctatacaaaagatccacaactcacacagcactatcaagggttttctcgaacgcgaacggccggctggtgagcgcgccctgccaaaaataaaatcagataagagcccggagatgactcaattgcgccagctcaaggagttgctcgataatgcacttaacgtggtgcattttgctaaacttctgacgaccaagactacgttggacaaccaagacgggaacttttacggggagttcggtgcgctctacgacgagctggcaaagatcgccactttgtacaacaaagtgagagattatctctcccaaaagccgttttccacggagaagtacaagctgaactttggcaaccccaccttgctgaacgggtgggatcttaacaaggaaaaagacaattttggcgttatccttcaaaaagacggctgctattatcttgcgctcctggataaagcccacaaaaaggtgtttgacaacgcccctaacgccggaaagagcgtctaccagaaaatggtgtacaagctcctccccggtcctaataagatgcttccaaaagtcttttttgcaaagtctaatctcgactactacaacccgtcggctgagctcctcgacaagtatgcgcaggggactcacaaaaagggaaacaattttaatctcaaagactgtcacgcactgatcgacttcttcaaagcatccatcaataaacaccccgaatggcaacatttcgggtttgagttctctccgacgagcagctatcaggatctctcggatttctacagggaagttgaacctcagggttaccaagtgaagtttgtggacataaatgccgagtatattgatgagctggtcgagcagggccagctctacctcttccagatttacaacaaggatttcagcccaaaggcgcatggaaaacccaacctgcataccttgtacttcaaagcccttttctcggagaacaacttggccaaccccatctataagttgaatggcgaggctgaaattttctacagaaaggcttctctggacatgaatgagactaccatccaccgcgcgggcgaagtgcttgagaacaagaacccagacaacccgaagaagagacaattcgtctacgacataattaaggataagagatatactcaggataaattcatgcttcatgttcctattacgatgaacttcggtgtgcagggcatgaccatcaaagaattcaacaagaaggtcaatcaatctattcagcagtacaacgatgtcaatgttatcggcatagatcgcggcgagcggcacttgctctaccttaccgtgattaacagcaaaggggagatcctggagcaacgcagccttaatgacataatcacaacctccgctaacgggacccagatgaccactccttatcacaagatccttgataagagggagattgagcgccttaacgcgcgggttggctggggcgagattgaaactataaaagagcttaaatccgggtaccttagccacgttgttcaccaaatatcgcaactcatgctcaagtataatgcaatcgttgtgctcgaggacctcaacttcggttttaagcggggcaggttcaaggtcgagaaacagatctatcaaaatttcgagaacgcactgattaagaagctgaaccatcttgcgctgaaggataaggctgacgacgaaataggatcctataaaaacgctctccagttgaccaacaactttacagatctcaagtcaatcggcaagcaaacagggttcctgttctacgtcccagcatggaacaccagcaaaatcgacccggccacgggatttgtcgacttgctgaagccgcgctatgaaaacatcgcgcagtctcaggcttttttcggcaaattcgataagattttctacaacgccgacaaagggtacttcgaattctatgtggactacgccaagttcacagataaggcgaagaattctcgccaaacctgggtgatatgttctcatggcgataagaggtatgtgtacgataagacggctaatcagaacaagggtgctaccattggaattaatgtcaatgatgagttgaagtcactcttcgcaaggtaccacattaatgataaacagccgaaccttgtgatggacatttgtcaaaataacgataaggagttccacaaaagcttgatgtatctgcttaaagccctgctcgcccttcgctactctaatgcgtcgtccgatgaggacttcatattgtctccagtggctgacgataaaggtgtgttcttcaactccgctttggccgacgacacccaaccgcagaacgctgacgctaatggtgcttaccatatagccctcaaagggctttggctccttaacgaacttaagaactccaatgacttggacaagatcaagctggcgattgataatcaaacgtggctgaatttcgcgcagaatcggtag

SEQ ID NO: 207 - DNA, 43 bp, Artificial
  synthetic
  gRNA (1)..(43)
aatttctacttcggtagattggagcaacacctgaaggaaggct

SEQ ID NO: 208 - DNA, 43 bp, Artificial
  synthetic
  gRNA (1)..(43)
aatttctactattgtagattggagcaacacctgaaggaaggct

SEQ ID NO: 209 - DNA, 44 bp, Artificial
  synthetic
  gRNA (1)..(44)
aatctctactctttgtagattggagcaacacctgaaggaaggct

SEQ ID NO: 210 - DNA, 42 bp, Artificial
  synthetic
  gRNA (1)..(42)
aatttctactgttgtagatccgaggaaaggatgggagacctg

SEQ ID NO: 211 - DNA, 42 bp, Artificial
  synthetic
  gRNA (1)..(42)
aatttctactgttgtagatacatgtctaatccaggttcatct

SEQ ID NO: 212 - DNA, 42 bp, Artificial
  synthetic
  gRNA (1)..(42)
aatttctactgttgtagatgcaagggagttcaagtcaattgg

SEQ ID NO: 213 - DNA, 42 bp, Artificial
  synthetic
  gRNA (1)..(42)
aatttctactgttgtagatctcatacatccacctttgccaag

SEQ ID NO: 214 - DNA, 42 bp, Artificial
  synthetic
  gRNA (1)..(42)
aatttctactgttgtagataggagcagtgggtaattttccga

SEQ ID NO: 215 - DNA, 42 bp, Artificial
  synthetic
  gRNA (1)..(42)
aatttctactgttgtagataacattgaaatgcaggtggtaga

SEQ ID NO: 216 - DNA, 42 bp, Artificial
  synthetic
  gRNA (1)..(42)
aatttctactgttgtagatttggatgtcaaccaagctcttga

SEQ ID NO: 217 - DNA, 43 bp, Artificial
  synthetic
  gRNA (1)..(43)
aatttctacttcggtagattccagtgacctaaaagacgataca

SEQ ID NO: 218 - DNA, 43 bp, Artificial
  synthetic
  gRNA (1)..(43)
aatttctactattgtagattccagtgacctaaaagacgataca

SEQ ID NO: 219 - DNA, 44 bp, Artificial
  synthetic
  gRNA (1)..(44)
aatctctactctttgtagattccagtgacctaaaagacgataca

SEQ ID NO: 220 - DNA, 44 bp, Artificial
  synthetic
  gRNA (1)..(44)
aatttctactaagtgtagattccagtgacctaaaagacgataca

SEQ ID NO: 221 - DNA, 7967 bp, Artificial
  synthetic
  Repair_Donor_Template_Plasmid (1)..(7967)
  Upstream_Arm (478)..(1529)
  CaMV_35S_terminator (1530)..(1773)
  hygromycin_resistance (1774)..(2806)
  ZmUbi_promoter (2839)..(4831)
  Downstream_Arm (4832)..(5900)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgctttttgtttttgggtcgcactgttcgatcgtagcatccatgaccactgtggcatcgctgtctttgctgccgcacttgctcatcaagccttccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaattttagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggagcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 222 - DNA, 7680 bp, Artificial
  synthetic
  Repair_Donor_Template_Plasmid (1)..(7680)
  Upstream_Arm (478)..(1386)
  CaMV_35S_terminator (1387)..(1630)
  hygromycin_resistance (1631)..(2663)
  ZmUbi_promoter (2696)..(4688)
  Downstream_Arm (4689)..(5613)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgccccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctggggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatgcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 223 - DNA, 7775 bp, Artificial
  synthetic
  Repair_Donor_Template_Plasmid (1)..(7775)
  Upstream_Arm (478)..(1456)
  CaMV_35S_terminator (1457)..(1700)
  hygromycin_resistance (1701)..(2733)
  ZmUbi_promoter (2766)..(4758)
  Downstream_Arm (4759)..(5708)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgctggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggaactgtcctgtgcatttcaagatttttactggactgaaaagtaatggaattgttcttgatcatcaacagatagtgatggagctaccagtggagcatggacttcttctggacaatctattagatcttgctcatgctccttttactcatacatccacctttgccaagggttggagtgttccaaggtatttacatacatatattttcacagccatgtggaattcttttttttttttttagaaaatggatagccatgtggaaatgtcttcagaaatcatcatgctgatgctatgttcatttcccagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaatgcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 224 - DNA, 7856 bp, Artificial
  synthetic
  Repair_Donor_Template_Plasmid (1)..(7856)
  Upstream_Arm (478)..(1456)
  CaMV_35S_terminator (1457)..(1700)
  hygromycin_resistance (1701)..(2733)
  ZmUbi_promoter (2766)..(4758)
  Downstream_Arm (4759)..(5789)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgctttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctggtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggaactgtcctgtgcatttcaagatttttactggactgaaaagtaatggaattgttcttgatcatcaacagatagtgatggagctaccagtggagcatggacttcttctggacaatctattagatcttgctcatgctccttttactcatacgcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 225 - DNA, 7890 bp, Artificial
  synthetic
  Repair_Donor_Template_Plasmid (1)..(7890)
  Upstream_Arm (478)..(1492)
  CaMV_35S_terminator (1493)..(1736)
  hygromycin_resistance (1737)..(2769)
  ZmUbi_promoter (2802)..(4794)
  Downstream_Arm (4795)..(5823)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgcgctcatcaagccttccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatccttagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggagcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 226 - DNA, 7637 bp, Artificial
  synthetic
  Repair_Donor_Template_Plasmid (1)..(7637)
  Upstream_Arm (478)..(1501)
  CaMV_35S_terminator (1502)..(1745)
  hygromycin_resistance (1746)..(2778)
  ZmUbi_promoter (2811)..(4803)
  Downstream_Arm (4804)..(5570)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgcctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggaactgtcctgtgcatttcaagatttttactggactgaaaagtaatggaattgttcttgatcatcaacagatagtgatggagctaccagtggagcatggacttcttctggacaatctattagatcttgctcatgctcctttagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgggttggagtgttccaaggtatttacatacatatattttcacagccatgtggaattcttttttttttttttagaaaatggatagccatgtggaaatgtcttcagaaatcatcatgctgatgctatgttcatttcccagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtgagtccgaaaaattcagagcaacttcatactaaactgttgtccatctcatgtcattacagtttgcacctgactatagtatgcggttacctttgttttgcatactgtcctctatacaacatctataataatcttgtatgatctttctgcaggtcttgaatgaggatcttcgactcgtgctcgggcagcaagaacggatgatcaatggcgcaaatgtctggaactggccagtatcatatgacaagcttggtatccggtatcggttgtggagagacgccattgagaggggagtagacaggttgccattcagtaaccaaagtgagagtggatcataggcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 227 - DNA, 7875 bp, Artificial
  synthetic
  Repair_Donor_Template_Plasmid (1)..(7875)
  Upstream_Arm (478)..(1457)
  CaMV_35S_terminator (1458)..(1701)
  hygromycin_resistance (1702)..(2734)
  ZmUbi_promoter (2767)..(4759)
  Downstream_Arm (4760)..(5808)
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatcccgggttgtagctccacgcgcttcggcaggggaagctctacttaatcggaagtccatatgatctatgtcgggtgcggagaaagaggtaatgaaatggcagcgatcgctggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtaaaaacaacgtgcgattcaggcatttttttacgaggtcagagttagcagttgcagaaacttatgtttatttgatgtggtttgcgcattctcaggtgccaatagattgtttagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgggaaaggatgggagacctggatgtgttatgaacacatgtgctcacagagcttgccctcttcatcttggctcagttaatgagggcagaatccaatgcccttaccatggtaagaaaagacagctttacatgaactttcatttctgcatgcttccgcatttatttctgaagtcttcagatgaaaatttgccaacagagagaagttgcgaaagtagtatttcagtttttttttgttttcataaccttcaggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagaggtaaaaggagatcatgtcatgctgcagcaaccatactatgtggaactgtcctgtgcatttcaagatttttactggactgaaaagtaatggaattgttcttgatcatcaacagatagtgatggagctaccagtggagcatggacttcttctggacaatctattagatcttgctcatgctccttttactcatacatccacctttgccaagggttggagtgttccaaggtatttacatacatatattttcacagccatgtggaattcttttttttttttttagaaaatggatagccatgtggaaatgtcttcagaaatcatcatgctgatgctatgttcatttcccagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactgcggccgcctatgactctcttaaggtagccaaataagcttgaattcagtacattaaaaacgtccgcaatgtgttattaagttgtctaagcccgggctgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 228 - DNA, 44 bp, Artificial
  synthetic
  gRNA (1)..(44)
aatttctactaagtgtagattggagcaacacctgaaggaaggct

SEQ ID NO: 229 - DNA, 43 bp, Artificial
  synthetic
  gRNA (1)..(43)
aatttctactgttgtagattggagcaacacctgaaggaaggct

SEQ ID NO: 230 - protein, 1067 aa, Omnitrophica WOR_2 bacterium GWF2_38_59
  Csm1 (1)..(1067)
  RuvCI_active_site (727)..(727)
  RuvCII_active_site (939)..(939)
  RuvCIII_active_site (1053)..(1053)
MKNGINLFKTKTTKTKGVDMEKYQITKTIRFKLLPDNAHEIVEKVKSLKTSNVDELMDEVKNVHLKGLELLFALKKYFYFDGNQCKSFKSTLEIKARWLRLYTPDQYYLKKSSKNSYQLKSLSYFKDVFNDWLFNWEESVSELAIIYEKYKICQHQRDSRADIALLIKKLSMKEYFPFISDLIDCVNDKNSNKTFLMKLSEELSVLLEKCNSRALPYQSNGIVVGKASLNYYTVSKSEKMLQNEYEDVCQSLDKNYDITEMKVILYKEKLDNLNFKDVTIANAYNLLKENKALQKRLFSEYVSQGKVLSLIKTELPLFSNINDNDFEKYKEWSNEIKKLADKKNTFCKKTQQDKIKDIQNKISELKKKRGALFQYKFTSFQKHCDNYKKVAVQYGKLKARKKAIEKDEIEANLLRYWSVILEQEDKHSLVLIPKNNAKDAKQYIETINTKGGKYIIHHLDSLTLRALNKLCFNAVDIEKGQMVRENTFYQGIKEEFERNKINCDNQGVLKIQGLYSFKTEGGQINEKEAVEFFKEVLKSNYAREVLNLPYDLESNIFQKEYTNLDQFRQDLEKCCYALHSKIGKDDLDEFTRRFEAQVFDITSIDLKSKKEKTKTTGEMKKHTQLWLEFWKGAIEQNFATRVNPELSIFWRAPKSSREKKYGKGSDLYDPNKNNRYLYEQYTLALTITENAGSHFKDIAFKDTSKIKEAIKEFNMSLSQSKYCFGIDRGNAELVSLCLIKNEKDFPFEKFPVYRLRDLTYQGDFKDKHDQMRYGVAIKNISYFIDQEDLFEKNNLSAIDMTTAKLIKNKIVLNGDVLTYLKLKEETAKHKLTQFFQGSSINKNSRVYFDEDENVFKITTNRNHNPEEIIYFYRGEYGAIKNKNDLEDILNEYLCKMETGESEIVLLNRVNHLRDAISANIVGILSYLIDLFPETIVALENLAKGTIDRHVSQSYENITRRFEWALYRKLLNKQLAPPELKENILLREGDDKIDQFGIIHFVEEKNTSKDCPNCRKTTQQTNDNKFKEKKFVCKSCGFDTSKDRKGMDSLNSPDTVAAYNVARKKFES

SEQ ID NO: 231 - protein, 1267 aa, Butyrivibrio hungatei
  Cpf1 (1)..(1267)
MLYDEYSTQYYKGDEKRPMLNYEEFTKRNHITKALRMELIPQGKTQNVIDEKGDRKYDAALYSSLERLKPVIDSFIRSTASRALSDVDYDFNAMHDAYINKDKKSWAKEEKALKKVLMKAVDEALPKGLKCSQINSAAFLQEVLREYVLHATDTELRKDVALKDIEETKGCLALFSKFLTTRITALTVWMPERVIENFKIYCSNIPRIEAIFNEAKDIANNYSDELELMKTAQYYTKILSQDAIDGYNLVIAGKITENGIETKGLNVLINEYNIDVKNQKLDKPYLRKINQLYKQTLFSSEKQFVITAIKTDDEVRRVIKSAWESFDGAATKMLGLFKETLEATNGNGVCVKGNRLHILSHALLGEHKAITDNLVKAELVEIHEMLKNEALKPSMRAELEKRVDIAQSLVVKKDYSFTALDEAVTSIDENVIGLSKGAFNLYVAKTEELIKEAKMYYKVLEGGDIFKKRHIKGDKHVQEMLVDFFDALTEVRNIISVISMPDENEDADVSFYNRFDEIYENIRLTYKAENLVRNYITKSVKDTAEEKQTCFGTPARLRTQWWNGEQKFAKNHAAIIKHDGKYYYFILAGDSKPIEIKEDGNSATGLLTLKKGQKSFMMLPKILFTDHAVPFFEGNKDAMEYTLDDESVIRPVKVGRMLYEIYKKGLFKREAVTSGAITEEEYAKNIQALIEKYTEFANAYVQYQKFNLDDINDPTRYSDIGEFFSEVDTCTSRLSWTYIDYAQIANLVDSGSAYLFLISTKFLYTESEDKNAYTKTFRSILSDANMDKTTILLNSNPAVFFRPQSIKKEITHKAGSIMVNKLTEDGEHIPKKIYEAIYKSKNEMSGVSEEDMAAANEYMRTHKVRSFKAKYDKTYRGNYMSDKYTLQLTYTKNNDVSDRVNDMLNDRVIEAMQDGFNIVSVARSTKDMVYALVLDSSLKIIKELSLNVIDGVDYYALLHDTYLEKKENKKLWIYDTENTELKSAYIDLAISEILKLAREYNAVIAVESISDAVKNKYSFIDNQVFKAFENRIAQRLSDLTYKDVVDGRPGSVSNPLQLSNNNGNTYQDGILFFINGAYTRGIDPSSGFTSLFDFSRYNSIASKRQFFSKMAKISYTGDSIVFDFDYVDYPVHVDTEKTKWQVKLSGDVVVYDREKKQNKRIKDVVNEIIIPLAGKTDLNGNIAENILNKDVPGAFVEELFRWFRYAVTGIHAQVKGKDEFYKSPVDGNEYNISNMLAFNLAKKLVFRLEYAGESKDFTKEWLNYMQA

SEQ ID NO: 232 - protein, 1270 aa, Coprococcus eutactus
  Cpf1 (1)..(1270)
MSKTLRNELRVGSEYTGKHIKECAIIAEDAVKAENQYIVKEMMDDFYRDFINRKLDALQGINWEQLFDIMKKAKLDKSNKVSKELDKIQESTRKEIVKIFSSDPIYKDMLKADMISKILPEYIVDKYGDAASRIEAVKVFYGFSGYFIDFWASRKNVFSDKNIASAIPHRIVNVNARIHLDNITAFNRIAEIAGDEVAGIAEDACAYLQNMSLEDVFTGACYGEFICQKDIDRYNNICGVINQHMNQYCQNKKISRSKFKMERLHKQILCRSESGFEIPIGFQTDGEVIDAINSFSTILEEKDILDRLRTLSQEVTGYDMERIYVSSKAFESVSKYIDHKWDVIASSMYNYFSGAVRGKDDKKDAKIQTEIKKIKSCSLLDLKKLVDMYYKMDGMCLEHEATEYVAGITEILVDFNYKTFDMDDSVKMIQNEHMINEIKEYLDTYMSIYHWAKDFMIDELVDRDMEFYSELDEIYYDLSDIVPLYNKVRNYVTQKPYSQDKIKLNFGSPTLANGWSKSKEFDNNVVVLLRDEKIYLAILNVGNKPSKDIMAGEDRRRSDTDYKKMNYYLLPGASKTLPHVFISSNAWKKSHGIPDEIMYGYNQNKHLKSSPNFDLEFCRKLIDYYKECIDSYPNYQIFNFKFAATETYNDISEFYKDVERQGYKIEWSYISEDDINQMDRDGQIYLFQIYNKDFAPNSKGMQNLHTLYLKNIFSEENLSDVVIKLNGEAELFFRKSSIQHKRGHKKGSVLVNKTYKTTEKTENGQGEIEVIESVPDQCYLELVKYWSEGGVGQLSEEASKYKDKVSHYAATMDIVKDRRYTEDKFFIHMPITINFKADNRNNVNEKVLKFIAENDDLHVIGIDRGERNLLYVSVIDSRGRIVEQKSFNIVENYESSKNVIRRHDYKGKLVNKEHYRNEARKSWKEIGKIKEIKEGYLSQVIHEISKLVLKYNAIIVMEDLNYGFKRGRFKVERQVYQKFETMLINKLAYLVDKSRAVDEPGGLLKGYQLTYVPDNLGELGSQCGIIFYVPAAYTSKIDPVTGFVDVFDFKAYSNAEARLDFINKLDCIRYDASRNKFEIAFDYGNFRTHHTTLAKTSWTIFIHGDRIKKERGSYGWKDEIIDIEARIRKLFEDTDIEYADGHNLIGDINELESPIQKKFVGELFDIIRFTVQLRNSKSEKYDGTEKEYDKIISPVMDEEGVFFTTDSYIRADGTELPKDADANGAYCIALKGLYDVLAVKKYWKEGEKFDRKLLAITNYNWFDFIQNRRF

SEQ ID NO: 233 - protein, 1329 aa, Candidatus Gracilibacteria bacterium CG1_02_38_174
  Cpf1 (1)..(1329)
MSNNFQEFTQKYALSKTLRFELKPVGKTKEILEKEMPMYQIINADKNIKAKYIQTKPFFDQLHRDFIKEAFENVELSGLSDFFENWKIYKQDKKANEKIYKKSAENLRKEVVSFLNAKGKDWAEKYHSSGLKKADIEILFEEGIFKVLEIRYGTDTNSFITNATTGEITSIFQGWKGFTGYFLKFWNTRENYYKTDGTSTAIATRIVDQNLPRYLENLEIFEKMKGKIDFESVRGDFSDFEKIGTVEYYSTCLLQEGIDGYNRIIGGYTYENGEKIKGINEIINLYRQTHKDEKVPFLKTLDKQIGSEKIAFMETIDTPEEFRKIFEEFVLKSSEKVVLLKQCLNHLFENELTDGVFLSKESLNTISHKWIDIGNMKLFHESLFTILKKEGAKYDSKEDEYKFPDFIRISDIKTALVKITTESFFWKNRYLYEKDENPTGFLTSDNSLWEGFIQIFSHEFSSLFERTEKDEEGKDIQWGYDISLLNIQKLLENNEYNPNDEKNKIIIKSFADDILRIYQMGKYFALEKKRQWNPDNLEIGEFYSHPEIGYDKFYFDSYKIIVQGYNDIRNYLTKNPWSEEKWKLNFENPTLANGWDKNKETDNSCIFLKRDNKFFLALMSRGNNQVFDERNIQKFAQNIEQGKYEKMVYKYMKDVALGIPKATTQLNAVQEHFFQSDKDYIITKGGSSIGEFIKPLRVTKRIFELNNRIYPKDNLGISFLRNQVNEKEQKNYIKIFQKEFITLGGDEVVYKKAVHDWIDFCKEYTKSYPSCAYFDYSGLKDTKEYSSIDEFYNDLDSFGYQISWQDISSSYIDELVESGKLYLFEIYNQDFSNGKTGAKNLHTLYFEHIFSKENQEVNFPLKLNGQAELFFRPKSIEAKGENRKFNREIIAKKRYTEDKIFFHVPLTLNRTEGDIYGFNTEINNFLAHNPDINIIGIDRGEKHLAYYSVIDQKGNIIESDSLNTVNEINYGEKLTDTAEKRKQARQDWQAVEGIKNLKKGYISAVVHKLTDLIIKYNAIVIFEDLNMRFKQIRGGIEKSVYQQLEKALIEKLNYLVEKGEINPEKAGHLLNAYQLTAPFETFKDMGKQTGIVFYTQAAYTSKIDPVTGWRPHLYLKYSSAEQVKKEIAKFSNIIWNNTEKRFDFMYDIRNFSTQKEYPKNNIWTVCSSVERYRWDKTLNQNKGDYVHYKSITPEFEKLFSDFQIDGTKNILEQINRMETKGNEKFFKSFIFFFGLICQIRNTNKADSDENKQDFILSPVVPFFDSRDSENTKNGLPRNGDENGAYNIARKGLIILQKINEFSDENGNCDKLGWKELSISQVDWDNYIKT

SEQ ID NO: 234 - protein, 1263 aa, Eubacterium sp. 41_20
  Cpf1 (1)..(1263)
MNNGTNNFQNFIGISSLQKTLRNALIPTETTQQFIVKNGIIKEDELRGKNRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKKEKTQVIKLFSRFATSFKDYFKNRANCFSADDISSSSCHRIVNDNAEIFFSNALVYRRIVKNLSNDDINKISGDMKDSLKEMSLEEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNDYNLDKIYIVSKFYESVSQKTYRDWETINTALEIHYNNILPGNGKSKADKVKKAVKNDLQKSITEINELVSNYKLCSDDNIKAETYIHEISHILNNFEAHELKYNPEIHLVESELKASELKNVLDIIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSAYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGYALPKDADANGAYCIALKGLYEIKQITENWKEDGKFSRDKLKISNKDWFDFIQNKRYL

SEQ ID NO: 235 - protein, 1305 aa, Eubacterium sp. CAG76_36_125
  Cpf1 (1)..(1305)
MNKAADNYTGGNYDEFIALSKVQKTLRNELKPTPFTAEHIKQRGIISEDEYRAQQSLELKKIADEYYRNYITHKLNGINNLDFYNLFDAIEEKYKKNDKDNRDKLDLVEKSKRGEIAKLLSADDNFKSMFEAKLITKLLPDYVEQNYIDEDKEKALETIALFKGFTTYFTDYFNIRKNMFKENGGASSICYRIVNVNASIFYDNLKTFMCIKEKAETEIALIEEELTELLDSWRLEHIFSEDYYNELLAQKGIDYYNQICGDVNKHMNLYCQQNKLKANVFKMTKLQKQIMGISEKAFEIPPMYQNDEEVYASFNEFISRLEEVKLTDRLRNILQNINIYNTAKIYINARYYTNVSTYVYGGWGVIESAIERYLCNTIAGKGQSKVKKIENAKKDNKFMSVKELDSIVAEYEPDYFNAPYIDDDDNAVKAFGGQGVLGYFNKMSELLADVSLYTIDYNSDDSLIENKESALRIKKQLDDIMSLYHWLQTFIIDEVVEKDNAFYAELEDICCELENVVTLYDRIRNYVTKKPYSTQKFKLNFASPTLAAGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFEETTQYNDIGQFYKDVEKQGYSISWVYISEADINRLDEEGKIYLFEIYNKDLSSHSTGKDNLHTMYLKNIFSEDNLKNICIELNGNAELFYRKSSMKRNITHKKDTVLVNKTYINEAGVRVSLTDEDYIKVYNYYNNDYVIDVEKDKKLVEILERIGHRKNPIDIIKDKRYTEDKYFLHLPITINYGVDDENINAKMIEYIAKHNNMNVIGIDRGERNLIYISVINNKGNIIEQKSFNLVNSYDYKNKLKNMEKTRDNARKNWQEIGKIKDVKSGYLSGVISKIARMVIDYNAIIVMEDLNKGFKRGRFKVERQVYQKFENMLISKLNYLVFKERKADENGGILRGYQLTYIPKSIKNVGKQCGCIFYVPAAYTSKIDPSTGFINIFDFKKYSGSGINAKVKDKKEFLMSMNSIRYINEGSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKLKESELYIGVTEWLDYIQNRRFE

SEQ ID NO: 236 - protein, 1265 aa, Firmicutes bacterium CAG_194_44_15
  Cpf1 (1)..(1265)
MERKDFINYDQVSKTIRNGLIPTEYTLKNIEETGVLVSDEYRAEVRNVLKKIMDDYYKEYINMCLNREIKMDWRPLFDAYELVKKGKMKPKEIENIQDEKRKEIYDILSAHDEFKKMFSAKMITELLPQFISQSTGYNEDEKKQYEEVIHIYSRFTSDFTDFFQNRKNVFSSAGIATSICNRIVNENAEIFSDNKSTFDRIKKDISYIDEIIDSDLKTYLDGWELEQIYSVDFYSRLMSQSGIDFYNMISGAVNKAVNEYCQKNGLNKNKYLLRKLRKQILSNSESTFQIPEKFLADEEVYKAVGQFIDNIKSKNVIEILKDIGSNCENYDLRRIYIAESAYEDVSIFMGYGWNGIKGCLEKKYEKEIAPGKAKDIKIKKLISQEKERSIGEIDELFHIYGEEKDGKAAIQYIEEVVELCNEVPTRLVYDSSEKLTENDNKAAEIKNVLDYYFKIFHWIKTFITDDILDKDIVFYSGIEFAYEEIKDIVPLYNKVRNYVTQKPYSSEKIKLKFGTPTLANGWSKSKEFDNNAILLVRDNKYYLGIFNVLNKPDKKIMAGYANKKNSSDYAKMVYNLLPGPSKMLPKVCLSQKGKDTYHPSAYIVDNYERKAHVKSSEHFSIQYCHDLIDYFKECIKRNDDWKCFDFKFSDTEQYNDISEFYKEVELQGYSIGWTYISGEDIEALDKEGKLYLFQIYNKDFSEQSHGTDNLHTMYLKNLFSPENLNNIVLKLNGEAELFYRKSSIKKPVVHKKGSILVNKTYTEKTGNGEEVRRPVPDDVYLELVNYYNGEQKAILSDEAKKYMKVVEHHEAVKDITKDYRYTVNKFFIHLPITINFKAEHTGNLNEMVIQYIAKQENMHVIGIDRGERNLIYVSVIDMNGKIKEQKSFNIVNSYNYQEKLRGREKDRLNARKNWKQIANIKEMKEGYLSLVIHEITEMMMKYNAIIAMEDLNYGFKRGRFKVERQVYQKFETMLISKLNYLVDKHKKVDEPGGLLRGYQFAYVPASLDRLGRQCGFIFYVPAAYTSKIDPTTGFVDLFNHSELIKAGKRRDNLSKFDGIYYDEQKDMFCYAFDYKNFVTHNTDIYQNSWEIYTNKERLRKIFGNGRPTGKTEKIELTQMMKEVLTGAGVEYKDGHNLIDDILNSNDNCIKQVLDIFLYSIQLRNSKGENEDSKESDYDRIISPVLNQENEFFDSVVYADKYKKDEKLADKPIDADANGAYCIALKGLYEILQIKNNWKEGEVFSRDTLKITNADWLRFMQSRGFE

SEQ ID NO: 237 - protein, 1129 aa, Alicyclobacillus acidoterrestris
  C2c1 (1)..(1129)
  RuvCI_active_site (570)..(570)
  RuvCII_active_site (848)..(848)
  RuvCIII_active_site (977)..(977)
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 238 - DNA, 32326 bp, Smithella sp. SCADC
  Smithella_sp_SCADC_Contig_212 (1)..(32326)
  CRISPR_array (8530)..(11064)
  Cas2 (11204)..(11527)
  Cas1 (11481)..(12461)
  Cas4 (12455)..(13015)
  Csm1 (13016)..(16210)
gtttcaatccacgcgcccacgcggggcgcgacactgccatgctgaagattactgatggccatttccgtttcaatccacgcgcccacgcggggcgcgacgaggagatgggcaaggccggtaattccgcgaaaagtttcaatccacgcgcccacgcggggcgcgacgatctacgacatcatcgggaaccgcaaagcgctctcgtttcaatccacgcgcccacgcggggcgcgactttattcccggaggtgcgctaatggcccgatgcttgtttcaatccacgcgcccacgcggggcgcgaccttttatcacatgctgattatacagacggtctatttgtttcaatccacgcgcccacgcggggcgcgacaactgctttgcatagttcagttcctgccaatgggtgtttcaatccacgcgcccacgcggggcgcgacgtcaccaccatcccttcaattgccttcttactttgtttcaatccacgcgcccacgcggggcgcgacctataaaagctcttttcttcattattaagcaccagtttcaatccacgcgcccacgcggggcgcgacgacaacatcgcccactttgaagccgtcagtaatgtttcaatccacgcgcccacgcggggcgcgactccaatgttttaatcgtccgattgagttaacacctgtttcaatccacgcgcccacgcggggcgcgacgtttacggtagttaaagttgaagtgtttcacatgtttcaatccacgcgcccacgcggggcgcgaccggaaaacttcatgtaacgccaaactgcatacgggtttcaatccacgcgcccacgcggggcgcgacacggcttgacgaatcagcgccaccattgcatcaggtttcaatccacgcgcccacgcggggcgcgactttattcaacacattccttgacatcatatacgagtttcaatccacgcgcccacgcggggcgcgactgacaagcaggatgaattaaccagataccagagagtttcaatccacgcgcccacgcggggcgcgacgtgtgaatgtccgcaagaccgccgcttacatcgtgtttcaatccacgcgcccacgcggggcgcgacaaaaataaggaggcaatatgcctacattaacaagtgtttcaatccacgcgcccacgcggggcgcgacaaagcggacacgactgctattctcgaagatacgggtttcaatccacgcgcccacgcggggcgcgacatttggaaactggaaaaatcattagtctacaacagcgtttcaatccacgcgcccacgcggggcgcgacatgtaaggttttcatcaatgatgcaatcatcaacgtttcaatccacgcgcccacgcggggcgcgacgactcagaaagcggctgttgctgctctaaaagacgtttcaatccacgcgcccacgcggggcgcgaccccgtcaaacatccccgtacgatctttagaactttgtttcaatccacgcgcccacgcggggcgcgacatcgtaaataccggttgagtgcgaagaaactatatgtttcaatccacgcgcccacgcggggcgcgacgttacttccatgtatgttgtcacatggggagaaaacgtttcaatccacgcgcccacgcggggcgcgacaacaattacgcacggcattattacaggaatttggtttcaatccacgcgcccacgcggggcgcgacacgaattttaagaatatgtggtggtggagatgtgtttcaatccacgcgcccacgcggggcgcgacttctatgcaagtggcggctggtggcattatccaagtttcaatccacgcgcccacgcggggcgcgacaccggccttttgccaactatatatgccttgtgatgtttcaatccacgcgcccacgcggggcgcgacaaaaacttaatgacaattcccaaccgtcaagatgtttcaatccacgcgcccacgcggggcgcgacttataggggtcttgtggaaattgaccctgtgactgtttcaatccacgcgcccacgcggggcgcgacgccacaactactccgtctgttccggtatctacaagtttcaatccacgcgcccacgcggggcgcgacgttatgcccatgcatgtttttacaaagcgaaggcgtttcaatccacgcgcccacgcggggcgcgacaataactatccgtaaggagatggtagattccaccgtttcaatccacgcgcccacgcggggcgcgaccgggcctgcctgcaagggatacatgagcgaaatctggtttcaatccacgcgcccacgcggggcgcgacaacggaggcatctgataattaccatgccattttgtttcaatccacgcgcccacgcggggcgcgacgtccaataatcgctgaatgatttaagttgtcccttgtttcaatccacgcgcccacgcggggcgcgacttccagacacctcctactaaaacttttgatcctgtttcaatccacgcgcccacgcggggcgcgactctgttgcacctgttgcattttaggttgttcgaacgtttcaatccacgcgcccacgcggggcgcgacagcaggaagcggaagccgctaaacaattacaaatgtttcaatccacgcgcccacgcggggcgcgacatttgatagatacagaagttgcaacaattatttccgtttcaatccacgcgcccacgcggggcgcgacttttgataatcctgcggaagtaagattacaggaagcgtttcaatccacgcgcccacgcggggcgcgacctccgctacttcttccggtttcgcatccttaccaggtttcaatccacgcgcccacgcggggcgcgacgcagtgtcggaagcagtggtactccatctggaatgtttcaatccacgcgcccacgcggggcgcgacgaaggtatccagatcgcagcagaaaaaacgcatcgtttcaatccacgcgcccacgcggggcgcgacattcttgctcctgtggtcttgttttagatagggacgtttcaatccacgcgcccacgcggggcgcgacctggcccgattgtcatgagaaacatgcctactttggggtttcaatccacgcgcccacgcggggcgcgacgattgtcccgagggcctgtaatataaggtcgccacaggtttcaatccacgcgcccacgcggggcgcgaccgtttacatctaactaattacaaatattaaaatatattctaatcatccgcgaatcttgcttttaaaaatatttcctttattaaattttcaaagagcaatttaaataataaaacaaatcagcaacttaattactgcgcgaaccttactcaaaattattgtcggcttgtggttcgcggaagctcttcaaaagtaaaaatttttcccgtcttccgaaatgataccaatcaaacaatgagcggtccttcctgatcaactgtcttttttgcgccgatatgctccacacgtctgcgccaattagatcctaaaaaataaaaacgaagactgtcttcttcagcatttatttctttaatcaggcgttcacgcaaaacagtccattgcgccgggtcaacaatgcattcaaacacggaatactgcacgcgctggccataatcctgacatgccttagctacgcgccgcaatcgtttcggccctttttcattgttcatggcgacgtcataactgaccagaactaacattattagcgttacctccttaaaacctgcgaattccccctcatcctcaccttctcccgcaaaggggcgaaggcattatttggaattaatatttatttccagataaacggcggataaccgtccagatcaccacgcaggcatcgcgccaaaagcaatgcctgaacatgaaacagcaaaccgattgtcaccttttcatccagaaacgggtgcataatttcttcccgctttctttcctgataggccacaagtaatgtttttcttgtttcatcattcatcataaccgcgcccgcttccgttttattaaaacctttgtcctgcacctgccgcagattgatcaaagaaagagccaaacgatccgccagaaatggacgaaactcttccattaaatccaaagccaggctgggccggcccggcctgtcgcgatgcaaaaaaccaaccgccggatcaagaccgaccgcttccagtgcggagcggcaatcatgcaccaacaatgtataaagaaaagaaagcagacaattagcattatccaacggcggacggcgattgcgctcctgaaaattaaaacattctttttgcgcaacaatcaaattatcaaaaacactgaaataagtatgcgcggcgtcgccttccaatccgcgcacggcatcaagcgattgattcaactcaagcgactgcaaagaacggtttagattagctatacttaggcttaacgcattgttattcatcttctctgaatgatctcttagcgcacgctggagcacagtccggcagttagcaattttaccggtaacaaaagctttagccatttgcgcggaataattctgatcatcagcaaaacgatattgctggcggcgcaacaatacattgccggacaccggaccctgcactcgcgccaaaaaacgtccatattcggataaaaaactgataccgacgccattttcaccacaaaatcccattagaaatgggctgcaagatacattgccgaagcagacaatgccgccgatggtgtgcaccggcaagcgtagacgcacttcctgatttactttgaccaccacagtttcgccttccttggcaagataagcgccctgtgttgttacatacaaagtattaagaagctttttcatgtttgatccgcatcgcttctgtcattttttctccaatcgttttcttttttccggcgcactcaggtagttatcttttgagacaaccattttctttgtttctttctccaatttttcacgggcatctccggcaatccgcccgccttttctggcagcagtacggttttcatcaaagccctgtgcatcctgagttttggtgatctccgttgtggcggcttcacccagcatggaaaagatttattccagatcgttcatatgatcccgcagattttcgcgcttcagaccctttaaatctttatactccgatggcgtcaggccaaaggtcgctttggatatttcagccgtcaagatcgcatattccctctcctgcccgacctgccgcttcttccattcatcggtcagttcagcccggatggcaatgccgcgcatcctcttttcaatccagtcatcggaatatcccttggcccgataaatcgcttttgtcctttttgttgccagttccgggtcttcaatttcctgcacacgttcataaccgacttttgccagccagcgtttgaaaggctcggccttgggcgaaggaatcgactggataatgcggaaaagaccttctgtattggcgcagtcggtttctcgctgtttcccgtctggagctggcagtttcaacccgtgacaaaatgtcacgacttcactgccttcgtccttgagtctttgttttaattttcgccagtatgctccggcatcagcactttctgtcagtacagaacaaacatcaacaactgaaaaccaccactcattattgtggatggcttttctgattcccttccctttgaaaacagcaatttttgtttccatgattctctcctaaaaaccattccctgtttcatcgagcattcgttttaagtaactctcgaccgtccgctttttctgtattgtcttcggcatacattctgccataagcgaacagctttcacaacgtttggcatagacaggcgcgggcgtaattcctgcatcaatcaattcatgcgttttgattgccgcagcctccgtttcttgccttagcgcttcatcaaaatcaacatcaagacgccttctggtcttcccgtagaaaagcgcgccagcgggaatagaaacattgagcatttcttccaagcatattgcctgcgcacaaagctggattttatcggaatgatccggcttaggcttgccacgtttatattcgactggaaaagcctgccaggttccatcagcctgccggtgatattcaatcacatccgccttgccaatcagccctaaccgcagagatcgcaaagacgcgccgcgttcgatgcgcacatccccacgcgattcatcgccttcatcatgcacatgctcatgcataatccggccttcggcggttaatctgttttcagaccagacctgctcgacatgaatcaaagcgcactgccgcgaacaaaaggcataatgctgcagggcggataactggatcagatcgtccgggtgaaccataaacctccttaatacctaattcgttacctaattaattgggtattacctaattgcctgttttttgccatttagcgcctgcacctctggaaacacactcaacaatattgaggtgttgcatatcttttaaagcacgccggatagtatcaatgcctacgccgggacactttttttgaatatcggccacgctgaaattgccgggaaaacctgctacggcatttttaaccatttccgtcttttcacccttgggttgcgacatttcacccagtctttcttcaaattccttataagcgcttttgatgatgaaacacaggaaattgatatagtgccagggattgtgcttgccttcgtgccagccctgcgaactgagtttcagcgtttcgtaataacgctccttgttctgctcgatgagacgttccatactgatgtatctgcctacttcgatgcccgcatgataacactgaagaagcaccagcaggcgggataccctgccgttgccgtcgcggaaaggatggatgcacaaaaaatcaagattgtaggctgcaagggtaatgacccggtgcatttccgtttccttaaccgcatcttcccacgcggtatgcaattgttgcatagccttgggcgtttgcttcgcggaaaccgttcgaaacctgatgctggacgagccgtttgccctcttttcaataatgtcactgtctttttccttgtatttcccggcatcccatatttcgccgcgtgtcagcaaatgcagtttcctgcatgtctcttcggtaacgggcaatttagaacccaacgtgtgaatcaggttgagcgcctctcggtagccgcgcacttcttcctcggagcggtctgaaagaagtgatttgccgaagatgaccgtcccgatgcgtttttgttccacctcgaccccttcaatgcggttggacgaaacggcgctttcgatcagggcatgctctttgagcgaattgagccgctggggcgattgctttgtatagagttcctgcctgcctttggattcgctgatctcggaaagataccaggacgtcgttgcgggaatggattcaagacctgcaataaattgatttaaggttaaggtcgtcatctttcatccttttcggaaaccggtttttcttcgttcttatcggtctcgcgccggagccggttagattccgtcttcgcatctttcttacgaccccaataagcgccgcgccccttcttagacccagaatgctcgcttttctttacctgttgcgccataattattttccttttatcgctttttgcaggcattaccggcatgaagcaatagatgaagcagtaagtgaaacttgcgattttcctgttttctaaattacggccccacctgccgacataaattcttccagttgcaagatacctttcacgttctatcagcctgacgatgatattccactacatccgccttgccgatcaaccccagccgcaaagatcgcaataacgcgccgcgttcgatgcgcacatccccgcgcgattcatcgccttcatcatgcacatgctcatgcataatccggccttcggcggttaatctgttttcagaccagacctgctcgacatgaatcaaagcgcactgccgcgaacaaaaggcataatgctgcaaagccgaaagctgaattaaatcatcttcattatacatatcgccggttattacttattttattacctaattgcgggtgccttacggatttaccggataatcgacaaccttatcgacaacataatcgacaaccggttatttcatcacaaggaaatcagcagacaccgtactagtatttatccttcctcggccttccgccttttcctggaactaaaatcctctctagtgcatacttgcaaaagttaccgatatgtcatttcgaccgaagggagaaatcttattcaatgattataaagatttctcagtcacttcgttccttcgaaatgacacggttaatattgaaatcaagcgctagcttactctccagccgcttaataaaatgaatattccccaacggcctgcccgtctgctcatgccgatggattaataattcatcttcttcacaaaataaggtgtcctgccgacgattgcctcgccgggtgacatgatgaggatattttgctgcgactactcttgcaatacggcccatgtttattgtctatgactatcatcactgcttgtccagaaaaaactagtatggtgtccccagatttctagatgtctatatctacaatagtagaaatttaatccgtcctttggacttcgttacccaatatcacattggtaagaatctacaatagtagaaatttaatccgtcctttggacacgattgaacaatacctgatcgattaatctacaatagtagaaatttaatccgtcctttggacaattcgtttaacaattcaacgatctaatatctacaatagtagaaatttaatccgtcctttggacgatatgtttgatgcacttgcgggaaaaatctacaatagtagaaatttaatccgtcctttggacgtcatcaataatatctgatgtgatgtgccaatatctacaatagtagaaatttaatccgtcctttggacatattctccatcagtatagcaatttacttgtatctacaatagtagaaatttaatccgtcctttggactaataaatatgcccaacaatatataaaaatctacaatagtagaaatttaatccgtcctttggacctcgataatgcaatggccgaagctttagcatctacaatagtagaaatttaatccgtcctttggacgaaattaacgacatgaacgaagcgtttgatctacaatagtagaaatttaatccgtcctttggacagtggaaatgtaacagctgcaatctggctggaatctacaatagtagaaatttaatccgtcctttggacagacaattacaagcggtgcagctgcagtatctacaatagtagaaatttaatccgtcctttggacgtctggccggacatagcctccgttatcaatctacaatagtagaaatttaatccgtcctttggacactatacttatgtcaggcttatgctggaatctacaatagtagaaatttaatccgtcctttggactaagagaatgccttgtgtcccttagcccatctacaatagtagaaatttaatccgtcctttggacacgattgaacaatacctgatcgattaatctacaatagtagaaatttaatccgtcctttggacatgattacaagaaaagagataaatgaccatctacaatagtagaaatttaatccgtcctttggactttctttgtgttgagacaatccttctatatctacaatagtagaaatttaatccgtcctttggacgaagacaaggaacatttgcgcttcctgtatctacaatagtagaaatttaatccgtcctttggacacagataaactaatataaaaaaagttgttatctacaatagtagaaatttaatccgtcctttggacgataaactaactagaaaacaattttatatctacaatagtagaaatttaatccgtcctttggacctagtatggttaaatcattatgaaaatctatctacaatagtagaaatttaatccgtcctttggacctcatattcgtcaaaaatcgagccgtcgtatctacaatagtagaaatttaatccgtcctttggacctgatatacagagatgattactataaatctacaatagtagaaatttaatccgtcctttggacgtccctccttttcacaatagcctccgatctacaatagtagaaatttaatccgtcctttggacactcgaaatatcaaagcagttgccggaatctacaatagtagaaatttaatccgtcctttggacagcaggtacaacagggggctatgtcaatctacaatagtagaaatttaatccgtcctttggactcctttaaaaagggaaatccattttgtatctacaatagtagaaatttaatccgtcctttggacctcaatcagatattagaagttaaatcaaaatctacaatagtagaaatttaatccgtcctttggactggacaacgtcaatctcagacacagaaaatctacaatagtagaaatttaatccgtcctttggacttttgatatgcaaccagaagaggaggatatctacaatagtagaaatttaatccgtcctttggacaacttggattgttctgcaataccaaaaatctacaatagtagaaatttaatccgtcctttggacgttgcaaggcctagttgctgaacttgagatctacaatagtagaaatttaatccgtcctttggactgagacatactggcctttgttggatagtatctacaatagtagaaatttaatccgtcctttggactattttaccttttcccttcagccggtattatctacaatagtagaaatttaatccgtcctttggactagtttcaaaagcggaatcgcctataaatctacaatagtagaaatttaatccgtcctttggacgtcagggtagcggagtgtcaattaaccgatctacaatagtagaaatttaatccgtcctttggacccatgtatgaaaatacaagtgaaccttgcatctacaatagtagaaatttaatccgtcctttggacatttcaaaagccgaagatgaagtttataaatctacaatagtagaaatttaatccgtcctttggacataatggaaaatgtgactggtctatgacatctacaatagtagaaatttaatccgtcctttggacagataacaacttatagcacctggctatatagttgtttaataagcacatttttctttcacgcgcaagattaaattgctgaaacaccataaaatcagccaatttttgccattaagaccccggtttgcaaatttaccaacggctatattattatcaaatcctcatcactattttttgcatagccgaattttattttttcacaagttttgctcaagatgaatatgatgacgctgtccgtctgttcaaacttgtcgccataatattcttctatttccgttgtaatattctctatgattctgtcgctatttttaatctcaaaaaccgaatattgcaagcgatatccatatttttttaaaaattttgcaaactgcgttcttaatttattattgctgatatcatatgacactaaaagcatacagctacgccttgtgaacagattcattaatattgaaaacaggataatcatttatttctttttgccgaatgaatgcgcgataataactttgtgtgtataaaaatatatcttccttatactcaataatcgcctccagcaaccagcgtgtgtattctttgcttttcgcgtattttaaaaagtactgccctttccggacatcaaaatcatcattattaatctgattcagattataagcgctctttattttcttatcgacaatacagcgaaacggctctactaaatcgcagaccagagatttcctttgataaaagaattgatgatagacgcctttataaatatcgaatccataaaggttaagcatattctccgctagataaaataaaaatgtatagcccatatccagcagaacattgatcggatctcttttcgcccgtggttttctccccttccattccatatcgccataccattccgaaaaaaataaccgtgaagaaaccccttccatgcccagcaattcctgcaatttttcaaaatcaccaacctgcttttcataattcttcattagttccaaagaacgtttcagatcttcttctttttttcttatacttttcaataaaattatttggttctggattttatttttaacaatatgttttgctatatccagaccttgatatgaatactgtttctcacgcaataaaaaattgccatcggtaggcgtactccacacgccgatgcaccggaaattaacggacagcaaataaatgggaaaggcaaatttcttgcttcgttccagcaggcctgaggttacaacacaatgcccgacaatccacaacgccagcatgcgatagcacgtggtttgcaaaataactttctcatcagcatcagcaacaatcaaattatcattttgaaatgaaaaccgctggccttcgctggtaaagattacgacaatcattttttctttaaagtcaggatagcttaacatggcgacacatcacaaagttgagaataaatacatcgttcacatttcgatctgttcggtgcaagaactgcactctcaaaattaaaattattcatgtcgtaaatcagtttttcaaactttgactgcatttgcgcatcattctcaggaagaggaatcggatagttcttattatgcaccaagtcatgtataacaatttcattgactgtgtagcccatttctctcagcgcatgacactgcgcataaacctgaaacacataaccatcataaatggtttttatctcgcgtttcctttcagtaagtttacccgtcgaacaatcgaacacatcaacttttccgcagatgttgtatttttcagaaaatacttccatatcctgcaaaatatttttgcgtgtactgtaacttttatctccgataggtttgtgagccgcttcaccggctatttgcggcttttgtttatataattcatagttcagcccgccatacaactgatggaaataaatcgagcgcggacaaaatataaaatcgttcaagaatgataaagtgatgtatggttccatttatttgtacttttgcaagtcttcaaatcctcttttggcaatattgaaagctgcaactttatcggggtcgtttaaaccttcaaaacctttaaggtcatttcttgtatcaaacccacattggcatttacaaaatccttcttgcttatttttatcataatctttgaatcttcgaagacactttggacaagtggtacttgtttcttctgggcttacaaatttgataattccaaactgttgtatgttttcatatttaggctgtttaacatcttttaaaggaaatttttcaagttctcttaatttaataagttcgctaattggcggcacatatccctcttgctgaaattttcggtacaatgcccattccaaaggccgttcgatgttgccctcaaatttatttctgtccgattcaactttggtttgttttaaatcttcaatagagataatgccccgatatttttgatacaagtaataaatcacgcctatcatattgcctgccagtgccctttttgtctgattaatttgctcttcttctcttgcttcatttatttgttgactggcaaaataggcaaacaggtaattgctaatttcttggtaaggtttaatgtattcaaaatccaatctgcttatataaatatccttatcttttccttctatttcgaaatatagtttgtaatctttctcttttagttcagcgtgtggattttcgattagttcctcatatatttttcgttgggcatgcaatatcctcaaattcaaaaaagtgatcatgtcgccatttaaaatgattttcccatttatcacttttgccgtcgttaaatctatcgcggatacatgtttttctttaaacagttcattgtacgtttcattaaacttaccatctctgaatgttttttcataaagctcttcatttaaaaaataggataggttttgaatcgctttgtacggtttttcgcgtattaccaattcacgctctttgttataaatgtatccatgcttgaagaagtccaattttttaagttcgtaaactgtaaacaattgcggttctttgtctttattcattaaggccaaagttgctaattcaatttcgcccgcatcaatgccgtaaaaccacaactgatttttattgaattctttttttaatgtctgattaattttttcgttatacttaactatttcagtgcctttcttctttgtatcctcaaaggcaaaagtaatttcattattcaaagcattgtctgtaaccgtggtacaaagagtatattgctcatgcaagtatctattccgtttttccggctcatataacaccgatctttcaccatatttttctattcttgttttttttgcttttcgccagacaattgctatttcaggattcagacgcaaattgtaattaatctcctcattttgttttgtccagaatcggttccaaatccgtgtgtgtcctttcaggttcttttgttctgatctttgcaaatcaaggcttgtgatcttaaatatttgagtgttataattttccagtatttctttttttaaactttcggaaatgatttgcttctttgcataacagcatttttccagggctatttgaaaatcctgccttgtttcaaatgactggatggctacttcattaaatacactctgcggtaaagctaaagtattttttacaaagtccgtttttaaaacagactgataaaacgatattaatttaggttcatcaatttctttatcgtcgttgcttttatgaaaacaaaattctccaaattctttttggttatattgaggcaattctttttgaatttcaggcaaaaaagtattgccgtttataccaaagcacaatttgcgcaatgcacggtaagtcattgattcaaaataatataatgtcgaacttgaacttgaacttgcaccatcatcttttgccccccagacttttctgtaaagctcatttgttttctctttcggtattaaaatcaaagaatgttttaaattatcttccagcaccaacgcccaatactgtaacctttgcgaatcaatcctttcgttctctatccccttgatttggccttttaattttccgcgctttccggctatttctttatacagctcgcagagttggacatatttcccaaatgcctttttaaaatattcgcctctgtttttttttaattttgtaatttcagtctgaagtttttgagcttcgggactatcttttgaaagcaaactttttgcagtacttttttgcgttatcttgttggacagttttaaatattcatcatatttatttgattcagtttggaacagaggaaacttactttttaaatcatcaaagaccaacccgttggaaacagcttctaaaaactctgatttcttagttgatttacgttttttgatttccgaataaaattcgattaatggtaattcttttaatggtaattcttttaaagggattaggtttaattctctaagcaactggtcatattttttattaccataccttgcgtgtaattgtttttttagcgcaacaatctcagcttcaaaatccttttgctttttattgatggtataatagttgaagcttgctttggctatcgcgatgcccgaagattgagagggcaaataattttgctcgcatattttcaacactgcttcgaattcacttagcaacgctgttagtttacttttcgtatcctcgctgtttttatcattactattatcaacaaaaccttttatgaatggcaactgatgtttgattccaagttttctgattgaaagagcaatttccgcatcccttgttttagactcttccggtttattgcaatccgcatttactctttcaatagtgctttcccattcttttaaaaaagcctcaaacacatgagacaaataaacaacatcgctgattttgattttcttttccgtattgtctttcttccaattgtaaaacaaatcttttgtaaacaaacgcaaccatctaaaatgaacagtgacatttgatttcagcttatgattatcactgtatcggatgtattcattcaatagtttcggtaattcctgacccctttgaactaatcttaaaagattgtttttcttctctgcgtttgtagaattttgcagaacagcaacctgacggcttatgtcttgaattttatcaggcagcaatttgaaacgaatggttttagtaattttgtatttttccataataatttatcctttcagtgtttgcataaattcaagccattctttgttgcttatggctaactttacttttttcaggtcgtccgtcttactgatctgttccagacaccataaacctttaagagcgatatgataagcgccgttggcgtcggcattcttgggcatatcgtcacctgctttccttgaatcaaagaattttcccatactgtctgcaacaggcgaaagaatataatcctgctctgtctcacctttttctccgttgttgtgcctcaatgaaagtgtgacacttaaatatttcattaatgtcctgaagaaatcggccaattcctgacttgctatctgctgtttcaaatccttgccgcttttatagtccacctttccgtcaaacagggatttcagttctgctgtgatatcgtatttttcctgactgcccctgttgttgtttaacgccctgttccaggcgtacctgtcctcattggtggtgcaaactgtccatttcgtccttccaccatctgcctttccggtgaagtttttaaaatcaaaagcaaattcaaaataatctgccttgctgttgagacggatggaatcaaacttctcaaagaagtcctttgcctgtttcaggttctcatatctaggtttcaggaaatcaatgaaacctgtggcagggtcagtcttgcttgtgttccacgcaggcacgtagaaaataaatccgttctgcttccccattttctggaaactttcaaacttgttcgctaactggaatgcgttgagcagaccgccaagttcatttgcttttttattcttatccacaaggtaattgagtttatcaatcagcattttctcaaacttctggtaaacctgcttctccaccttctgccttccacgcttgaaaccgaagttcaaatcttccatcacaatgatggcgttgttttcaatcatcaaatcggtcagtttgtggatgacctgcgacagataaccttccttcagttccttaatggtctcaattacgccccattcctgccttgccgtggctctatcaccctctttcttgtccagcaggttgtgatagtcaactttctgcttttcattggcaatgacattcaaggtgtcctgcttgagaatcttacctttctgatttatcagggtgtagtaaagtagatgcctttctcccctgtctattccgatgatattaatatctgggttggccttgaggaactggttgaccctctggttcatattgaatatgccttcagccttgaaattcatggttatgggaacgtggaattggaacttatcaatggtgtagcgtttatccttgacgatgtcgtagttaaatgtacttgtggctttcggattgtctggattcttgttaataatactttcattggccttatgaatggtcgtgtttttctcggcaatggatttcttgcggtagaatacctcggcctcaccatttagtttataaaccacgtcttttaaattattctcatcaaagagcatcttccagtagagggtgtgcaggttgggcttgcccttactgaaaggtgagaaatccttgttgtatatttggaaaagatagagtttcccttcattgaccaaatcgtcaatgaaggaatcggctatgctctggaaacttatcttatagccctgatgttccacctcgtggtagaatccgcttaaatcagcataggtggatgtggctgaaaacctgaaatcaaagtttttccagtcctcgtgtttgttgattgagtctttgaaaaaatcaattaattggtggcaatgattcaggttgaaattatcaccttttttgtgcgtctcattctcgtagttttccagcagtttggctgacggagtaaattcctgtatccgtgactgcgaaaagaataccttcggcagcattttatttgctccaggcagaagcttgtaaaccattttctcgtagcaggaatcctttttatccgctttaggtacgtttctgaatatcctgttatgcctcttgtccataatgcccagataataaaggttctctttcctcagtataatagctgtattgtctgtttctttatttaaatcccatccacccagcaatgtggagttttcaaagttcagttttatcttttccgtgctgtatggtttctgtgtgaggtagttacgcaccttattgtagagtgcgatggtctgggtcagatggtcgtatagaggggtaaacagactatagaatgtttcgtctttctctttatcagtatccttcaggctcagcggtcttacaaaatgcataatgtccattatgctgtccataaatgcctttatctgtttgacctgatctttattgctcccgagcttctcattttcaggataaggggtgttcagcaaatccttgacagctatatagccttcattgaccttctgaattaaatcagtctctttgtcatcgcagaacttcgcaaagtaatcaacgatgactttcccactgttttttcccttaactgtttcattgtcgtactcatcaattgcggtctgaattaggctgacgttaaaatcctgtttgagccatttctctttccgctcttcgtatttctctgatttctctcttggcttgatggggtaggttgttgcgtagtaattatctaaagccctgttaataatgctccattctccaaatactttcctggaaacatcggtcaatgaagtgccgcttctgaaataaatcttagtcaggttgaaagattcaagattgcttacagcatttttgattgcatccaatacattggttgatttgccttcattggaaaaatgcagcaattcatttacatagaatttttctattgcttccagaatttcagtatcatttttgaatgcctccgcaataaatgacaggctctgcctgtcgctcaaaatctgcttgtagagttgcttgaacttgggctgtctttttttcttatcggtctgcttctggttaaaatcagtattgatatattcgtttaagcccttgattttggtttttccctcttcgggtgttctgccgccgattacggaattgtatatgtcaatccccgattgtgtaagtgtcttattgaaataatccagtgaaaatatttcttccaatgttgtacccttgataacatccttcatatcctttaatgtttgattaaaaggggaaagaagctcgggtgcttcttttttcatcttttcaaatatcttgatgttatcaatgaacttgggcagattctcatgtataagccggctcgcaatagccgttcgtttctcatccgccacatacatgtttgccctgttctggtgaaacccagtgaaataagttgtaaaagcttcaaactcctttacgttttttttgtcttcctcacaggcaaaactcatcaaatcgttctttattaattccttggcaaagagcgttttaaacttttcattgtttctaaaagcattcgcaatctgtttcctaagattttctttttctttatcaaacgcctttttatctttatcgtctttttcctgctttaaatataaagtcttatactcctcaagcccgtctaattttaaaccgttcagtgatttctcaatgaaatctttatgatattcatcaataatgttttttactttcttatatttttccgcacgatcctcgtctttttttaaaagacctttctgttctataaaatcttttgtttttccctgcgggatcaactcaaaacgcaaagtcttactcaccggatactgatttgtgaaattttcaaatagtgtttgcataatacaagtctccctttaaataaaattatactgaacttctaatctattttttattctaaactaactccacccccatagcgtgtcctacgaaaatatttatttggaacctgataatatatttgagcgtaggtatttataccaagtagccatcaaatattaacaggagccgcgggcgttggacccgatgccgcaaacctgcgaatgtcgtcgttctgcatctcatgcgatcattgggaaaagatttgacggcttgccactacttgatagtgccctgcatttgttccagcgtctttatgagttgcgggatatcccgttgacaaattttgaagattacctcaacatacactaccgaaataatcatgcgccaatatattgcgtaagccaatgacacctttccagtcaatatcagggtatttctttaaaaatgaaccttcagtttctttgtcgatctttttgaagctctcgccaacagcaataagcagcatggcgatggcatcgagtttatcatgattgatatcggttgccagaaaatcatttggcgttgtgacgcctacaaagcgcctgtttatgcgctcaacggcatccaggatctgttccagtttttcctcgaggagcaatttgtcatacatagacggcctcgcggtcaatccgtgcttttagatatttgttcatcatcgcccgataacgaatcacatctacgggcattttgaatttttcttccaacgcttctttaatgtgcaccatgtaaaataaatcaggctcattcatctccacaatcacatccacatcgctgtcgtcacgaatctcgttgcgggcaaaagatccgaaaatgcctatttttgtgactccatattgctttttcagatcaggcttaatcctgcgtaactcttgcaggacggtttcccgattatttatattcatactcccgcctcaataacctttattttgttatattataccataattagctgaaattttaatatcaattaaattaattttagccaggctcagtctctggattttttttatgaggtacaatttgagaaatgatggtcatttctttcccctgaatgtcaattttttcagccgttatttccgccctgtagtaatctctatgatcttcattccctgctttcttcttttgaaactattttaaagatgctgccttgaggcagattatttgttgagtgctgtgtgtgcttttacaatacaattgcatgtcattaccataaaaaaatattggcaagtcacttttgattcgcaaaattttattttgtcttaccacccctccacccccatagcatgtcctatgagaataatttttttgctgttcgttcatgcctccgtcacatcgcttcactttaccacttcccaccgccctgcctttttgccacctttgcgttgcagcacattcttagctttcaatttaaggtttttctttccctgaatttgagttcaattgtttcgtcttccttaaaacccatactcagtctccttcatgccaatgaattatcttttgaatcgattgtgtttattcctcttttgccgtcatcggcagttatttccaaaattgcttttttcatcaaccattgtcaccggctgttttttaccttcacctttgtgcttgcttactatgcatccacctccggcgcttcgcgccacccccgccagcgggggacattgcattccatcctctcttatgtcttgcgcctcgaacctcgcgtcccccaaaggtgtatggttttgattctactctttcccgacccccatagcgtgtcctatgagaaaataacttatatgtaatctgtaacgtatatttgtgagcatatttttaaatatgtccatcataaattccggattcccgccagaagcatgcgggaatgacagatggcgatggattccccggtcaaccggtattcgccggtctgcgcgctggggaataacaattttgatcttgatacctctgtcaaacagcataattacaaacatattatcaccggtacacctttttcatcttttcaatttcattttttatttccattcgcagtgattttggcgacacaacttccacctgcgcgccgtattttagtatttcgcgtttgatttcccggaagtcggacacgggtatggtgaggcagagtctgccgtctttttttatgacagtcttctgcgccggatgccaggcctgttcggcaatccaggaagaaacgtctttggaaaaacacagacagacttcatttgttgctttgccgtggaagatgccaaaagtgtgacggatatattctctgacttgttcagcggcaaaacgggtaacaattttattttcacaaggcgtgattgatttgatgcgcaataaaacaaaatccctgagttcatttttcaacgcgcagtgcgcaatgatatgccatgtgcccctgtagtgaagcaggtgcagcggcagaatgtcgcgggtggccgtttcggaattatgcggcgaagggtattctattctcacgggtttggcggaaagcagggcttcgagcatcgcgtgatatattttttcggctgttttggaatattcaatattgcggactgaaactttattgctcaagtctttgatttcgctgtgaaaccagagaaatctttctaaaatgattttcgatgccatgacgaatccaaaatcgatggattttacaactttgagagcagattaataatgcgagtatataataaagaatggattggaaagtcaattaaataaaatagcgttataaaataatgtttaagacccgcttccgtttccggcttttttattactcttccggtgataaaattcttaatctgctgtgttttcgactgtaaaagaagtatatgcaaaaacctattgccatccagacaataagacgaagccacgtatcaaacggcagaaatatcatctgaagaagagttacgatggcacccgcaacaggaacaaacggcacccacggtgtgcgaaaaacacgtggatattccggatgacgatagtgcagaacaagcacgcctatacatacaatggtaaatgccagtaaggttcctatggaaaccagttctccgaggatattgatgggaaaaaggcctgatataattgccgcgacacatcctgtcagaattgtcggtacatacggcgttttgaaacgcggatgtacgcgggcaaatgctttggggagcaaaccatcccgcgccattgcaaaaataacacgcggctgagccatgagcaatacgagaactacggaacttaatccggcaatagcgccaattttaatgaacggcctgagccacgctataccgggacctgcggcattaaccgcaacagcgataggatccggaacggcaagttccgtatatttcatgatgccggtaagcacggctgtcatcaggataaaaataatcgtgcagacaacaagcgatcccagtatgccgataggcatgtcgcgctgaggattacgcgcttcctgagctgcggtagaaaccacatcaaaaccgatataggcaaaaaagattacgcccgctccgcgtattactccggtccagccgaacgaaccgaactgacctgtattttcgggtagaaacggcgtccagttggcaaacctgatgaaaaaaattcccactacgataaaaagaacaatgactgtcagtttgacaagtacgataaaattgttaacccgggtcgattcgcgaatgccgataaccagcagtgttgtcataattcccacgataaaaatggccggacaattcaaaattgctccggtcgtactccagccatccgtaactgaataggaaaacggagactgacagaaaattgcgggaatgttgatattaaaatctttcagaaagctcaccacatatcccgaccaacccactgcaactgttgacgctccgaaaagatattccagcacaagatcccagccgattatccatgccataaattcgcccagagtagcgtatgcataggtataagcgcttccggaaattggaatcatcgaagcaaattcggcgtaacacaggccggccagagcacatccgaacgcggaaatgacaaaggaaagtataatggcgggaccggcgtaagttgccgcagcctggcctgacagcacaaaaattcccgcaccgatcatgacacctattccaaggctgatcagtccccccggtccaagcactctttttagttgatgttgttcaccctcaggctccgccatgataagccgtaacggctttcttgcgaacaaacctttcatagcctcagtccttctgtaatttatagcgtatcatagcgcttttttatggctgaaatatataaggaaatcttgtttgtatgtcaaataaaaaacccgctttcacacgggttttttattattattgttttttaatgtatgatttaattagctattgcttctgattaaagggcgtttgagaagtactgtatcgtatgtcaaaataattttgatcgcgcccttgaactgccgattctaaggatttttcgaaccttctgacttttcttttcttctctgcttgtgaagcccgggatgaggacgaactgcagggtctccttgaccatttcgatgtactctttatggttgagtttgaccatgggacggaagaagttttctccggagacaaaattatgaatgccgttcataactgtcaggacctccagcatgccactgggaggtgttttttttgcgtcctttgtcaaacccattgagcgggcaatgtcgccggtgaattccgggactttgaaatcaattatcatatcgtgccttgtcttgctgaaatatcgatggaacatgagattcgatacttcgggattggcgaacaggtagtccgtcatcaaagctatggcaatttttatacgttcatccaggggacggccatgaattattttttccaccgcgctaagctcacgtcccaagtcgcggttcatgtcgagaatgacggcctcatagaggtcctttttgtcaccccagtggtagtgcagtgtggaaatgtcgatgccaacttccttggcgagcatcctggttgtcgtaccgtggaaaccgtattcaccgaacacgatacgcgcagcggcaagaatccttgccttcatcgattcagggtctttgcgggctttttcgagggctgttctcattttttttattttatagtacgctttcatcgtttgcaagtttatttttcaatgtttgcttgaacaacttgtctcatgttaaaataaactatcagggacaatccatgtatctgcatttattttccagattataccgcgccttttgcttggccagttcatttactatacacaggccgccaccaagcttacagggatccatttgcagtactctattgttcaaccggtcatacatttccggatccttgataagtgcagcaaggtaccttgcctgcaatacatccatcactccaaattcaccattttccgccctgttgccgttagcaaatgcatctcgggaagattcagctccaccgcccaatgccatcctgaacatccataatcacatccggggtttccaactgcagcgttacccgcttggcaagattgaccccataccaggtcagagctttcaaatcatatttagtcaggaatttaaccgcatcataaacagttgtcccactttctaaagctttacgaaatttagaattattgactttcatggctcgcaaagtatattctgttccaaccgtataaagagatataaagtaacggcggtattctgtacggtgtgccttgttgccgtacacccggatacacccacggccagaaaaacaattaaactgatcatttaggttatgcgctttcggaattggagtttcagcaataaacaaatttcaaagctaaactctctcgaatattgtcgccggggcctgcccgccgccagtgcagagggtcaccagggcgtatttcgctttccgccgttgcagttcatgaatcgcggtgacactgagacggcacccgctgtttcccacagggtgtcccagcgccatggcgccgccattgacgttgagtttcgtcatatcggccttgacctctttcgcccaggccagcgggatcggcgcaaaggcctcgttcacttcgaagaggttgatgtcgtccattttcaaaccagccatcttgagcactttcggcgtcgccgtcatggggccggtgagcatcagcttagggtcggagccaactacggcgttggccacgacgcgagccagcggcgtcagccccagtttcttcactttttcaccgctcatgagcaaaatcgcggacaccccgtccgtaactgtgctggaaagaccggtcgtcatccagtcggttccgggcaataccttgagactgtcaagtccttccctggtaactccggcgcgcatcggctcgtcggtatcgcaaaggattttgttaccgtccttgtccaacccctgaaccgtcatgatctctttcttaaaatagccttctttcgtggcctttaaggccttttcgtgactcgcgatagcaaaatcctgacactcttccttggttactttccactggttggctacggcttgagcggagaccatctggttcggcatgccgtaacggtctaagtataattgcgtgattggatgacccgcattctctccgttgggtaacgtgccttgcacgtcggagctgatggtatacttggacatgagctcgcagccgctggcaattaccgtatccatagtccccgcggctatcatagccaatctgtatcgtggaaaggctgctcccgcactggcggttcacgctgatacctcccagcgtcaccggaagccgtgatgatagaacacccattcgcgcaatgttgaatccctgttcgccgatctggtacacgcatccagtgataacatcgtctaattgagttacgtcaagttggacgcgttaggcaacctcgttgagtacaagagcaagcagttccggggctatgtattcacgataatacccttttcgcctgccaaccggtgttctgacagcactgacaataaatacatctctcattcaatacctcctgttgaattaaataaaccgctcccctctaaataactgatttgcaacattgactatccgaccgccgtcgaaacggcatggtggtgaaaaaacgtactgagagaggagttacatcctctccagtcttttgagacagaactgtacaagaagacttacatattcctgcctttgtctttacgtgttatgaatctattaaaactaatacaaaggcccacaagttcggagttgctcccatttccttcttccatataatgataccatcatttgatggtatcattatatggaagtaatataaaagttaagtttatttttaatgtttaatttcttcagatatttcttctgatgggagtacgaacagtttattcttttattttttcttccagcggaccggtttcatgataaaggctagtgcttttccccatgttgataaatcttataacacgtctctggactaaaagcaacaaaaacccgctatttctaacgggtttttgcgcttcctaagactttaatggattatggcttggtgggcgatgtgagattcgaactcacggcacctggcttcggagcccgatacatgccctttaccacttcattcaacattttacgctcatttactatatctcaatagtttaggtaagttacatttaccttgacttactgtgagatttttgtatattcatcaccaaggttggaaattgatgcacttggtttatgatctgataacgaataaattttcccaaccttgaacatatgatgagaaagaactctacataaattatagagctatgtacacactttataattatttgtgaaataaattttccaacctgcagaggtattatgaagagatttaaaacgaattacaaaggtgtattttatcgtattggcgatagaataagcagtccgggtaaagaaaaaatattttacatcgtcttttaaaaagacggcaaagtctttgaagaaaaagtcgaccgtcaatttgccgatgacatgacaccttccagagcaagcaggttccgcgctgccagaatcgatggaaagcgtaaatcccgtaaagaaataagagatgaagtaaaagcagcaaaacaggcagaagccggtaaaatgactattgcacgtctatgggataagtatgaagcacataagtcagaattaaaatctataaatatagaaaagggaagatgtcaaaaatatttattacctgaatttggaaataaagaaccacatgacattatcaagcttgacgttgatcgtttgcgtattaaactgtcaaagaatttgaaaccgcaatccgttaaacacgtattaggattgctcaagcgtattgttaatttcggggtctccatgcagttatgtgagaatttaaattttaaaactgatcctatcaaagtagacaatttaaaaacaaagatttaacctccgaacaaagtaaagcggcttttaacagcaattaataattcaaatgacaataaacgggataggcgtgaaatggctgtatatttgtgattagctgaataggtgttgcttatgcagcggcaagcgacatgctgaaagcctcggagcgatagcgaaataagcggcacactttttcagcggataaaatcacaaattatgaatatagccttatcatgcctataccaacctcaagcagggcgggaaaatcagatgtagcttggtggcgccggaaactaggcgtttgtaataagcagaaaaggggaagggttgggctaccgagaagatttgctccaaatacaaagccctattaaaaaatacttgaccttatctccttgttgtgctacattgtagcccaatggaggtaattatatatggctacaaacccagttgtccgtgcgcgtattgatgatcacgttaaggcgcaagccgaagcggtgcttgcttctatcgggcttaccgttgcggatgctttccgcatgatgatgattcgcattgcaaaagaaaaggcgttgccttttgagcctctcatccccaatgacgaaactattgaggccatgaaggccgctcgtcgcggcaagcttactacggcaggaacccctgaccgcctgcttaagaaactcaatgcgggagattagatacacggcccgctttaagcgtgactacaaacgggaaaaatcagggcggcacagcaaaatcatcaacgccgccttgatgaagatcgtgaatttactcgccgccgatatgcctttaccaaaaagcaatgttgaccatccacttattggtgaatggtcagatcatcgtgactgccatgtcaagcccgatctcatacttatttaccgcaaacccgacgatgagcatctcgatctggtgcgtctcggttcgcacagccagcttggtttatgataagagactatcgccaaagcctttcaaaccgcgccggtttggcggcggtgtatctgactgtgtgctgaatgttcctgtgtcctataagaaaattcttagtaaaacgtagggagatcttttgatgggtgcagggaagaattaatgggggttacaatccccttaaaataccttccctgcaatataaaaataacagggtggggacaacagtgagtatacgcttaagacatgtttgcatgaagttttatagattctttactctgtaaaactttaagtattccggcaaggctatccatgcgaggattgcctttgggaccaagcatcctgtgaatgcttttgcttgatttatgaagcttctgcgccagtaccggaaatgttatcgtcgcatttatataatcccggagtattgatttggcgacactgtgatcgccggcaagtaattcattgatagcttctataagcaacgcatggcggaaatccggatcggaaatcactcttcgttgcacagtatctttaaattttcttgtaagagccatatctatacctcctgtttctttctacttttataatcctgccaatattttttagctttcttgatgtctttgctctgtgttttcttatctcctccgcagagcaaaattatcaatttacttccatcttttccgaaataaatcctgtagcccggtccaaaatcaattttatattcagctactccactgccgatatattttacgttggaataatttcccatttgaagtctggttattgctactgttacctttacagctgcaacggcatccaagtcatcaaaccatgagccaaatggtgagcgtccctcaatttccaattcttctacttcataatagaatgaattattcataggtgaatagtagcatataagttaccatttgtcaaatacatttcaagttatagctattgtacagatttaatcagccagaagatacgctatcatttataaaagaattacggaaagttactctgtaaaaaaacaatctgggtgggaacaatagacggaataggcgtgaaatggctgtatatttgtgattagctgaataggtgtgtcttatccgttcaaaagcaatggccgcctgataaaaatgtttatgccggatggtgttgtatttgataatctcgaaccattatattttttatcgaaactcaacaaacaactccgtatgattacgctcatcgctccttttcctgaattaaaaagattttccaatatcggcttaccattgatatatgcaatcctattaaaggatgatcataataatatttttctgttcaggcggaaaaaagaaaaagacattttcaacctgtcatctgattatcccagccccatagtgaaactgacaaagatatctcaggaaaataaatctgtcatatccattgctcagaaagaattatcgagagacgttttcgataaaatacgcgagtggaatttgctttccatagcagatatcaaatacttgattaatgaagaaattatattcacgaagttgtttgaaccgaccgaagctgaaattgttcaacttgaacttcagcgaaacatcggagtagaaaatctttccagttatgaactaatgttgattaatgagattcgaacgaaagacattgccatagaaaaagtgtcaaaaatgataaaagaaaaataaaatgcttatggtcatgtcactttggctctcatacttaagataatcaataccatccttatgtatttgacaaaaagtgtctaattaagtcttgtcttagttattgacttcacctaaggcgcaacttgtttgagttagcaagagtgtagattaccatttgaaatgtggtatccaacatcgctaatgagtcaagcaacaacctctttttacccgggtggctggatgaagacccttgttatgcagggttggctaagagcagaaaaaagagagaggaacgttatgaggcttgggtgaaagatctattcccgaaggcgaatgggaattgatgcgcaaatcgctacagcgaggacaattaaccggcagcaatcggttcattgacgaaattgaaacaaaaattaatcatcgtatcgaatttcgagggcaaggacgaccgaggaagaataaaaaataaatctgtccccttttactagtccccttttactaccttttactataatttgttaaatatcaacgatggaaatataatgaaagttttaatgacattttatttctaatttctggtttaatttgtagtattttttttgtaagataaaatcatatgaattttttctgatactaaaacatttggaaaaatcaacaacgccacctgcaatatattttagtttgttattaggctctacataaaaatattttaaataacttttttcacttgaagtatctattatatttgtttctataagttcacttattttttcaggggcagttgcagaatttatatctcggattggggctaatattatgctggtaagctttgtcttattttctaaggaaatttcacatgaatgtgataataccattgcatctgcaaaatctggcggttttgaaacgttccaaccttttttatcctcggaagaagtagttatataatttattatgccaaaatgaattgcgccaagtagatgaatattggataagatgtctccttgtattaaagaatttgtatcaaatgtttcatcatcgatataatacatagactaatcatcccattcatctttgaatgaaattgtatcagataggtcgataatattttttaataaattaaattcatcaatagttttgatatatattatgtctggttgtaagtctgccaggtatacggcatcaaagggatcgtcgataaaaggttgtgaagaaagttttagattaagaagatagtctgcaatatatctgtcgactctatcttgaagtttctcttcgaactctggttcagaaagtagctcatttattaaatct

SEQ ID NO: 239 - protein, 986 aa, Deltaproteobacteria bacterium
  CasX (1)..(986)
  RuvCI_active_site (672)..(672)
  RuvCII_active_site (769)..(769)
  RuvCIII_active_site (935)..(935)
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

We claim:

1. A method of modifying a nucleotide sequence at a target site in the genome of a eukaryotic cell comprising:
   introducing into said eukaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Csm1 polypeptide; and
   (ii) a Csm1 polypeptide, or a polynucleotide encoding a Csm1 polypeptide, wherein the Csm1 polypeptide comprises: (a) an RNA-binding portion that interacts with the DNA-targeting RNA; and (b) an activity portion that exhibits site-directed enzymatic activity,
   wherein said Csm1 polypeptide has at least 95% identity with a sequence selected from the group consisting of: SEQ ID NOs: 134, 147, 160, and 230, and has Csm1 nuclease activity, wherein said method modifies said nucleotide sequence at said target site, and wherein said genome of a eukaryotic cell is a nuclear, plastid, or mitochondrial genome.

2. A method of modifying a nucleotide sequence at a target site in the genome of a prokaryotic cell comprising:
   introducing into said prokaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Csm1 polypeptide; and
   (ii) a Csm1 polypeptide, or a polynucleotide encoding a Csm1 polypeptide, wherein the Csm1 polypeptide comprises: (a) an RNA-binding portion that interacts with the DNA-targeting RNA; and (b) an activity portion that exhibits site-directed enzymatic activity,
   wherein said Csm1 polypeptide has at least 95% identity with a sequence selected from the group consisting of: SEQ ID NOs: 134, 147, 160, and 230 and has Csm1 nuclease activity, wherein said method modifies said nucleotide sequence at said target site, wherein said genome of a prokaryotic cell is a chromosomal, plasmid, or other intracellular DNA sequence, and wherein said prokaryotic cell is not the natural host of a gene encoding said Csm1 polypeptide.

3. The method of claim 1 wherein said eukaryotic cell is a plant cell.

4. The method of claim 3, further comprising:
   culturing the plant cell to produce a plant under conditions in which the Csm1 polypeptide is expressed and cleaves the nucleotide sequence at the target site to produce a modified nucleotide sequence; and selecting a plant comprising said modified nucleotide sequence.

5. The method of claim 1, wherein said Csm1 polypeptide comprises a sequence selected from the group consisting of SEQ ID NOs: 134, 147, 160, and 230.

6. The method of claim 2, wherein said Csm1 polypeptide comprises a sequence selected from the group consisting of SEQ ID NOs: 134, 147, 160, and 230.

7. The method of claim 1, wherein said modified nucleotide sequence comprises insertion of heterologous DNA into the genome of the cell, deletion of a nucleotide sequence from the genome of the cell, or mutation of at least one nucleotide in the genome of the cell.

8. The method of claim 2, wherein said modified nucleotide sequence comprises insertion of heterologous DNA into the genome of the cell, deletion of a nucleotide sequence from the genome of the cell, or mutation of at least one nucleotide in the genome of the cell.

9. The method of claim 1 wherein said modified nucleotide sequence comprises insertion of a polynucleotide that encodes a protein conferring antibiotic or herbicide tolerance to transformed cells.

10. The method of claim 9 wherein said polynucleotide that encodes a protein conferring antibiotic or herbicide tolerance comprises SEQ ID NO:76, or encodes a protein that comprises SEQ ID NO:77.

11. A nucleic acid molecule comprising a polynucleotide sequence encoding a Csm1 polypeptide, wherein said polynucleotide sequence has at least 95% identity with a sequence selected from the group consisting of SEQ ID NOs: 185, 186, and 193, or a fragment or variant thereof, or wherein said polynucleotide sequence encodes a Csm1 polypeptide with at least 95% identity to a sequence selected from the group consisting of SEQ ID NOs: 134, 147, 160, and 230 and has Csm1 nuclease activity, and wherein said polynucleotide sequence encoding a Csm1 polypeptide is operably linked to a promoter that is heterologous to the polynucleotide sequence encoding a Csm1 polypeptide.

12. The nucleic acid molecule of claim 11 wherein said nucleic acid molecule comprising a polynucleotide sequence encoding a Csm1 polypeptide comprises a sequence selected from the group consisting of SEQ ID NOs: 185, 186, and 193, or encodes a Csm1 polypeptide that comprises a sequence selected from the group consisting of SEQ ID NOs: 134, 147, 160, and 230.

13. A Csm1 polypeptide encoded by the nucleic acid molecule of claim 11.

14. A plant cell, eukaryotic cell, or prokaryotic cell comprising the nucleic acid molecule of claim 11.

15. A plant cell, eukaryotic cell, or prokaryotic cell comprising the nucleic acid molecule of claim 12.

16. A eukaryotic cell produced by the method of claim 1.

17. The eukaryotic cell of claim 16 wherein said eukaryotic cell is a plant cell.

18. A plant comprising the nucleic acid molecule of claim 11.

19. A plant comprising the nucleic acid molecule of claim 12.

20. A plant produced by the method of claim 3.

21. The seed of the plant of claim 18.

22. The seed of the plant of claim 20.

23. The nucleic acid molecule of claim 11 wherein said polynucleotide sequence encoding a Csm1 polypeptide is codon-optimized for expression in a plant cell.

24. The method of claim 3 wherein said polynucleotide encoding a Csm1 polypeptide is codon-optimized for expression in a plant cell.

\* \* \* \* \*